(12) United States Patent
McElvain et al.

(10) Patent No.: US 9,238,828 B2
(45) Date of Patent: Jan. 19, 2016

(54) KETO-ISOVALERATE DECARBOXYLASE ENZYMES AND METHODS OF USE THEREOF

(75) Inventors: Jessica McElvain, Wilmington, DE (US); Daniel P O'Keefe, Ridley Park, PA (US); Brian James Paul, Wilmington, DE (US); Mark S Payne, Wilmington, DE (US); Steven Cary Rothman, Wilmington, DE (US); Hongxian He, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 13/560,147

(22) Filed: Jul. 27, 2012

(65) Prior Publication Data

US 2013/0203138 A1    Aug. 8, 2013

Related U.S. Application Data

(60) Provisional application No. 61/512,866, filed on Jul. 28, 2011.

(51) Int. Cl.
*C12P 7/16* (2006.01)
*C12P 7/24* (2006.01)
*C12N 9/04* (2006.01)

(52) U.S. Cl.
CPC ............. *C12P 7/16* (2013.01); *C12N 9/0006* (2013.01); *C12P 7/24* (2013.01); *Y02E 50/10* (2013.01)

(58) Field of Classification Search
None
See application file for complete search history.

(56) References Cited

U.S. PATENT DOCUMENTS

| | | |
|---|---|---|
| 7,541,173 B2 | 6/2009 | Bramucci et al. |
| 7,851,188 B2 | 12/2010 | Donaldson et al. |
| 7,910,342 B2 | 3/2011 | Liao et al. |
| 7,993,889 B1 | 8/2011 | Donaldson et al. |
| 8,017,364 B2 | 9/2011 | Bramucci et al. |
| 8,129,162 B2 | 3/2012 | Li et al. |
| 8,178,328 B2 | 5/2012 | Donaldson et al. |
| 8,188,250 B2 | 5/2012 | Bramucci et al. |
| 8,206,970 B2 | 6/2012 | Eliot et al. |
| 8,222,017 B2 | 7/2012 | Li et al. |
| 8,241,878 B2 | 8/2012 | Anthony et al. |
| 8,273,558 B2 | 9/2012 | Donaldson et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,465,964 B2 | 6/2013 | Anthony |
| 8,518,678 B2 | 8/2013 | Flint et al. |
| 8,557,562 B2 | 10/2013 | Bramucci et al. |
| 8,614,085 B2 | 12/2013 | Van Dyk |
| 8,637,281 B2 | 1/2014 | Paul et al. |
| 8,637,289 B2 | 1/2014 | Anthony et al. |
| 8,652,823 B2 | 2/2014 | Flint et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony |
| 8,795,992 B2 | 8/2014 | Bramucci et al. |
| 8,828,694 B2 | 9/2014 | Anthony et al. |
| 8,828,704 B2 | 9/2014 | Donaldson et al. |
| 2007/0259411 A1 | 11/2007 | Bramucci et al. |
| 2007/0292927 A1 | 12/2007 | Donaldson et al. |
| 2008/0182308 A1 | 7/2008 | Donaldson et al. |
| 2009/0081746 A1* | 3/2009 | Liao et al. ............. 435/160 |
| 2009/0239275 A1 | 9/2009 | Donaldson et al. |
| 2009/0305363 A1 | 12/2009 | Anthony et al. |
| 2010/0081154 A1 | 4/2010 | Flint et al. |
| 2010/0081179 A1 | 4/2010 | Anthony et al. |
| 2010/0081182 A1 | 4/2010 | Paul et al. |
| 2010/0093020 A1 | 4/2010 | Bramucci et al. |
| 2010/0120105 A1 | 5/2010 | Anthony et al. |
| 2010/0197519 A1 | 8/2010 | Li et al. |
| 2011/0076733 A1* | 3/2011 | Urano et al. ............. 435/160 |
| 2011/0097773 A1* | 4/2011 | Grady et al. ............. 435/160 |
| 2011/0112334 A1 | 5/2011 | Donaldson et al. |
| 2011/0124060 A1 | 5/2011 | Anthony et al. |
| 2011/0136192 A1 | 6/2011 | Paul et al. |
| 2011/0195505 A1 | 8/2011 | Euler et al. |
| 2011/0244536 A1 | 10/2011 | Nagarajan et al. |
| 2011/0250610 A1 | 10/2011 | Bramucci et al. |
| 2011/0287500 A1* | 11/2011 | Urano et al. ............. 435/160 |
| 2012/0040440 A1 | 2/2012 | Alsaker et al. |
| 2012/0058541 A1 | 3/2012 | Alsaker et al. |
| 2012/0064561 A1 | 3/2012 | Flint et al. |
| 2012/0149080 A1 | 6/2012 | Bramucci et al. |
| 2012/0156735 A1 | 6/2012 | Dauner et al. |
| 2012/0196341 A1 | 8/2012 | Donaldson et al. |
| 2012/0237988 A1* | 9/2012 | Anthony et al. ............. 435/135 |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0072394 A1 | 3/2013 | Li et al. |

(Continued)

FOREIGN PATENT DOCUMENTS

| | | |
|---|---|---|
| WO | WO2008098227 | 8/2008 |
| WO | WO2009076480 | 6/2009 |

(Continued)

OTHER PUBLICATIONS

Li et al. (2008) UniProt, Accession No. Q742Q2.*

(Continued)

*Primary Examiner* — Nashaat Nashed

(57) ABSTRACT

Provided herein are polypeptides and polynucleotides encoding such polypeptides which have ketoisovalerate decarboxylase activity. Also provided are recombinant host cells comprising such polypeptides and polynucleotides and methods of use thereof.

9 Claims, 3 Drawing Sheets

(56) References Cited

U.S. PATENT DOCUMENTS

Figure 1:
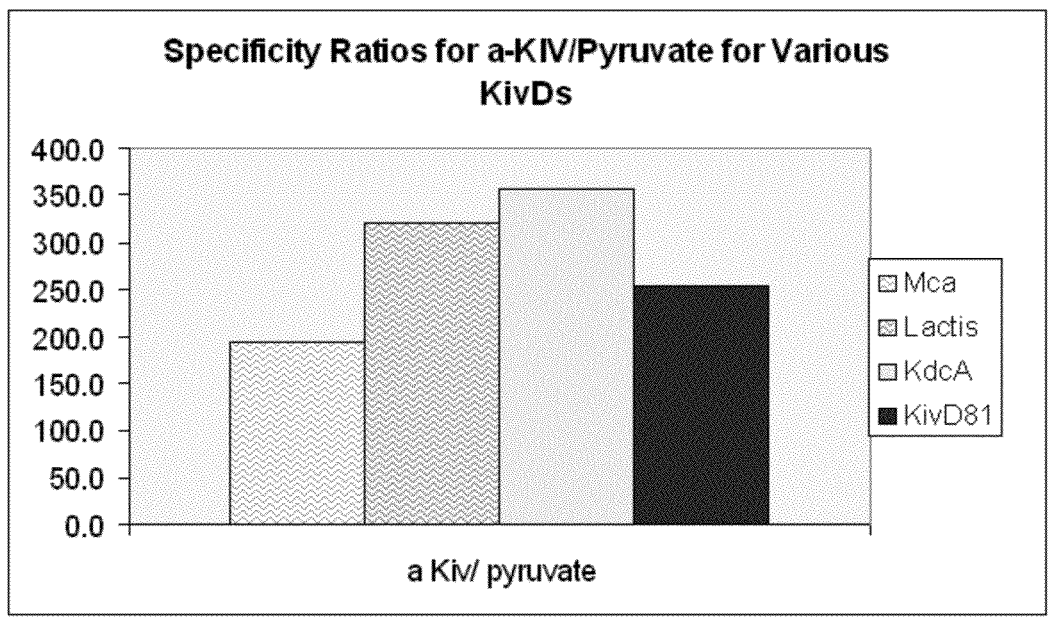

| | | |
|---|---|---|
| 2013/0130342 A1 | 5/2013 | Larossa |
| 2013/0171706 A1 | 7/2013 | Donaldson et al. |
| 2013/0252296 A1 | 9/2013 | Maggio-Hall |
| 2013/0316414 A1 | 11/2013 | Paul |
| 2013/0344551 A1 | 12/2013 | Li et al. |
| 2014/0004526 A1 | 1/2014 | Dauner et al. |
| 2014/0030776 A1 | 1/2014 | Flint et al. |
| 2014/0030782 A1 | 1/2014 | Anthony et al. |
| 2014/0030783 A1 | 1/2014 | Anthony et al. |
| 2014/0030794 A1 | 1/2014 | Donaldson et al. |
| 2014/0038263 A1 | 2/2014 | Flint et al. |
| 2014/0038268 A1 | 2/2014 | Flint et al. |
| 2014/0051133 A1 | 2/2014 | Govindarajan et al. |
| 2014/0051137 A1 | 2/2014 | Flint et al. |
| 2014/0051151 A1 | 2/2014 | Donaldson et al. |
| 2014/0057329 A1 | 2/2014 | Li et al. |
| 2014/0093930 A1 | 4/2014 | Li et al. |
| 2014/0096439 A1 | 4/2014 | Bramucci et al. |
| 2014/0141479 A1 | 5/2014 | Anthony et al. |
| 2014/0162333 A1 | 6/2014 | Anthony et al. |
| 2014/0170732 A1 | 6/2014 | Bramucci et al. |
| 2014/0186910 A1 | 7/2014 | Maggio-Hall et al. |
| 2014/0186911 A1 | 7/2014 | Anthony et al. |

FOREIGN PATENT DOCUMENTS

| WO | WO2012033832 | 3/2012 |
|---|---|---|
| WO | WO2013016724 | 1/2013 |

OTHER PUBLICATIONS

U.S. Appl. No. 13/227,016, filed Sep. 7, 2011 (Butamax).
U.S. Appl. No. 14/207,823, filed Mar. 13, 2004 (Butamax).
U.S. Appl. No. 14/208,474, filed Mar. 13, 2014 (Butamax).
U.S. Appl. No. 14/282,722, filed May 20, 2014 (Butamax).
U.S. Appl. No. 14/302,097, filed Jun. 11, 2014 (Butamax).
U.S. Appl. No. 14/335,734, filed Jul. 18, 2014 (Butamax).
U.S. Appl. No. 14/339,388, filed Jul. 23, 2014 (Butamax).
U.S. Appl. No. 14/368,970, filed Jun. 26, 2014 (Butamax).
Savrasova, et al., Use of the valine biosynthetic pathway to convert glucose into isobutanol, J. Ind. Microbiol. Biotechnol. 38:1287-1294, 2011; published online: Dec. 15, 2010.
de la Plaza, et al., Biochemical and molecular characterization of alpha-ketoisovalerate decarboxylase, an enzyme involved in the formation of aldehydes from amino acids by Lactococcus lactis, FEMS Microbiol. Lett. 238:367-374, 2004.
Gocke, et al., Branched-Chain Keto Acid Decarboxylase from Lactococcus lactis (KdcA), a Valuable Thiamine Diphosphate-Dependent Enzyme for Asymmetric C-C Bond Formation, Adv. Synth. Catal. 349:1425-1435, 2007.
Iding, et al., Application of alpha-keto acid decarboxylases in biotransformations, Biochimica et Biophysica Acta 1385:307-322, 1998.
Atsumi, et al. Engineering the isobutanol biosynthetic pathway in *Escherichia coli* by comparison of three aldehyde reductase/alcohol dehydrogenase genes, Appl. Microbiol. Biotechnol. 85:651-657, 2010.
Berthold, et al., Structure of the branched-chain keto acid decarboxylase (KdcA) from *Lactococcus lactis* provides insights into the structural basis for the chemoselective and enantioselective carboligation reaction, Acta Cryst., Biological Crystallography D63:1217-1224, 2007.
Chang, et al., Aspartate-27 and glutamate-473 are involved in catalysis by Zymomonas mobilis pyruvate decarboxylase, Biochem. J. 339:255-260, 1999.
Herschlag, The Role of Induced Fit and Conformational Changes of Enzymes in Specificity and Catalysis, Bioorgan. Chem. 16:62-96, 1988.
Smit, et al., Identification, Cloning, and Characterization of a Lactococcus lactis Branched-Chain alpha-Keto Acid Decarboxylase Involved in Flavor Formation, Appl. Environ. Microbiol. 71:303-311, 2005.
Yep, et al., Determinants of substrate specificity in KdcA, a thiamin diphosphate-dependent decarboxylase, Bioorgan. Chem. 34:325-336, 2006.
International Search Report and Written Opinion of the International Searching Authority for corresponding International Application No. PCT/US2012/048737, dated Mar. 1, 2013.
International Preliminary Report on Patentability or corresponding International Application No. PCT/US2012/048737, dated Jan. 28, 2014.
NCBI Reference Sequence: ZP-04750101.1, indole-3-pyruvate decarboxylase [Mycobacterium kansasii ATCC 12478], Dec. 10, 2010.
UniProt Accession No. D7UWC4_LISGR, indolepyruvate decarboxylase, EC = 4.1.1.74, Listeria grayi DSM 20601, Oct. 5, 2010.
UniProt Accession No. B9E770_MACJ, indole-3-pyruvate decarboxylase homolog, Macrococcus caseolyticus (strain JCSC5402), Mar. 24, 2009.

* cited by examiner

KETO-ISOVALERATE DECARBOXYLASE ENZYMES AND METHODS OF USE THEREOF

CROSS-REFERENCE TO RELATED APPLICATIONS

This application is related to and claims the benefit of priority to U.S. Provisional Patent Application No. 61/512,866, filed Jul. 28, 2011, herein incorporated by reference.

GOVERNMENT LICENSE RIGHTS

This invention was made with Government support under Agreement DE-AR0000006 awarded by the United States Department of Energy. The Government has certain rights in this invention.

FIELD OF THE INVENTION

The invention relates to polypeptides having α-keto-isovalerate decarboxylase activity suited for performance in isobutanol production pathways.

BACKGROUND OF THE INVENTION

Butanol is an important industrial chemical, useful as a fuel additive, as a feedstock chemical in the plastics industry, and as a food grade extractant in the food and flavor industry. Each year 10 to 12 billion pounds of butanol are produced by petrochemical means and the need for this commodity chemical will likely increase in the future.

Methods for the chemical synthesis of the butanol isomer isobutanol are known, such as oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini et al., *J. Molec. Catal. A. Chem.* 220:215-220, 2004). These processes use starting materials derived from petrochemicals. The production of isobutanol from plant-derived raw materials could minimize the use of fossil fuels and would represent an advance in the art.

U.S. Pat. No. 7,851,188 describes enzymatic pathways for the production of isobutanol in recombinant microorganisms. The penultimate step in one metabolic pathway described therein for the production of isobutanol is the conversion of α-ketoisovalerate to isobutyraldehyde. There remains a need in the art to identify additional enzymes that are suitable for use in isobutanol biosynthetic pathways.

SUMMARY OF THE INVENTION

Provided herein are recombinant host cells and methods of converting α-ketoisovalerate to isobutyraldehyde employing the polypeptides disclosed. In embodiments, methods comprise: (a) providing a polypeptide wherein said polypeptide comprises at least one of: (i) at least 80%, at least 85%, at least 90%, at least 95%, or at least 98% identity to SEQ ID NO: 51, 52, 53, 55, 56, 58, 59, 61 or 63 or an active fragment thereof; or (ii) α-ketoisovalerate decarboxylase activity, a specificity ratio for α-ketoisovalerate to pyruvate greater than about 1 and thiamine diphosphate cofactor activation constant ($K_c$) of about 20 μM or less; and (b) contacting said polypeptide with α-ketoisovalerate under conditions wherein isobutyraldehyde is produced. In embodiments, the polypeptide comprises the amino acid sequence of SEQ ID NO: 51, 52, 53, 55, 56, 58, 59, 61 or 63. In embodiments, the polypeptide comprises a sequence from *Listeria grayi* or *Macrococcus caseolyticus*. In embodiments, the polypeptide comprises the amino acid sequence of SEQ ID NO: 58 or 61. In embodiments, the contacting occurs in the presence of less than about 30 mg/L, less than about 20 mg/L, or less than about 10 mg/L thiamine. In embodiments, the contacting occurs within a recombinant host cell and wherein the polypeptide is heterologous to recombinant host cell. In embodiments, the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula,* or *Saccharomyces*. In embodiments, the recombinant host cell is *Saccharomyces cerevisiae*. In embodiments, the recombinant host cell further comprises heterologous polynucleotides encoding polypeptides which catalyze the substrate to product conversions: (a) pyruvate to acetolactate; (b) acetolactate to 2,3-dihydroxyisovalerate; and (c) 2,3-dihydroxyisovalerate to 2-ketoisovalerate. In embodiments, the host cell further comprises a heterologous polynucleotide encoding a polypeptide which catalyzes the substrate to product conversion isobutyraldehyde to isobutanol. In embodiments, the recombinant host cell further comprises reduced or eliminated pyruvate decarboxylase activity. In embodiments, the recombinant host cell further comprises at least one deletion, mutation, and/or substitution in an endogenous gene encoding a polypeptide affecting Fe—S cluster biosynthesis. In embodiments, the recombinant host cell comprises deletion of fra2. In embodiments, the recombinant host cell comprises reduced or eliminated glycerol-3-phosphate dehydrogenase activity.

Provided herein also are methods of producing isobutanol comprising: (a) providing a recombinant host cell comprising an isobutanol production pathway, the production pathway comprising a polypeptide wherein said polypeptide comprises at least one of: (i) at least 80%, at least 85%, at least 90%, at least 95%, or at least 98% identity to SEQ ID NO: 51, 52, 53, 55, 56, 58, 59, 61 or 63 or an active fragment thereof; or (ii) α-ketoisovalerate decarboxylase activity, a specificity ratio for α-ketoisovalerate to pyruvate greater than 1, and thiamine diphosphate cofactor activation constant ($K_c$) of about 20 μM or less; and (b) contacting the recombinant host cell with a carbon substrate under conditions whereby isobutanol is produced. In embodiments, the polypeptide comprises the amino acid sequence of SEQ ID NO: 51, 52, 53, 55, 56, 58, 59, 61 or 63. In embodiments, the polypeptide comprises a sequence from *Listeria grayi* or *Macrococcus caseolyticus*. In embodiments, the polypeptide has a KIVD cluster profile HMM E value of less than 1E-223 using the hmmsearch program. In embodiments, the methods further comprise isolating the isobutanol, and in embodiments, isolating comprises liquid-liquid extraction. In embodiments, the extractant for liquid-liquid extraction comprises $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. In embodiments, the recombinant host cell is *Saccharomyces cerevisiae*. In embodiments, methods of producing isobutanol provided herein comprise: (a) providing a recombinant host cell comprising an isobutanol biosynthetic comprising a polypeptide having at least 80%, at least 85%, at least 90%, at least 95%, or at least 98% identity to SEQ ID NO: 52 or 61; and (b) contacting the recombinant host cell with a carbon substrate under conditions whereby isobutanol is produced. In embodiments, the contacting occurs in the presence of less than about 30 g/L thiamine.

In embodiments, methods and recombinant host cells provided herein comprise polypeptides having at least about 80%, 85%, 90%, 95%, or 98% identity to SEQ ID NO: SEQ ID NO: 51, 52, 53, 55, 56, 58, 59, 61, 63, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, or 416, or an active fragment thereof.

BRIEF DESCRIPTION OF THE DRAWINGS AND INCORPORATION OF THE SEQUENCE LISTING AND TABLE FILED ELECTRONICALLY HEREWITH

FIG. 1 depicts specificity ratio data for the substrates α-ketoisovalerate and pyruvate for example KIVD polypeptides (from left to right: Mca, *L. lactis*, KdcA, kivD81).

Figure 2:
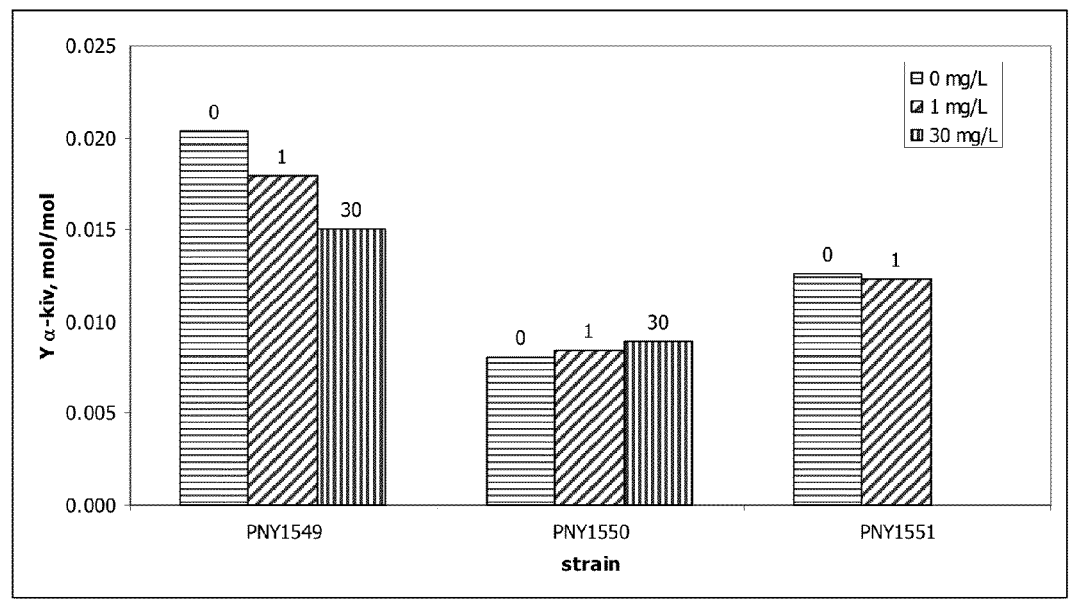
Figure 2:
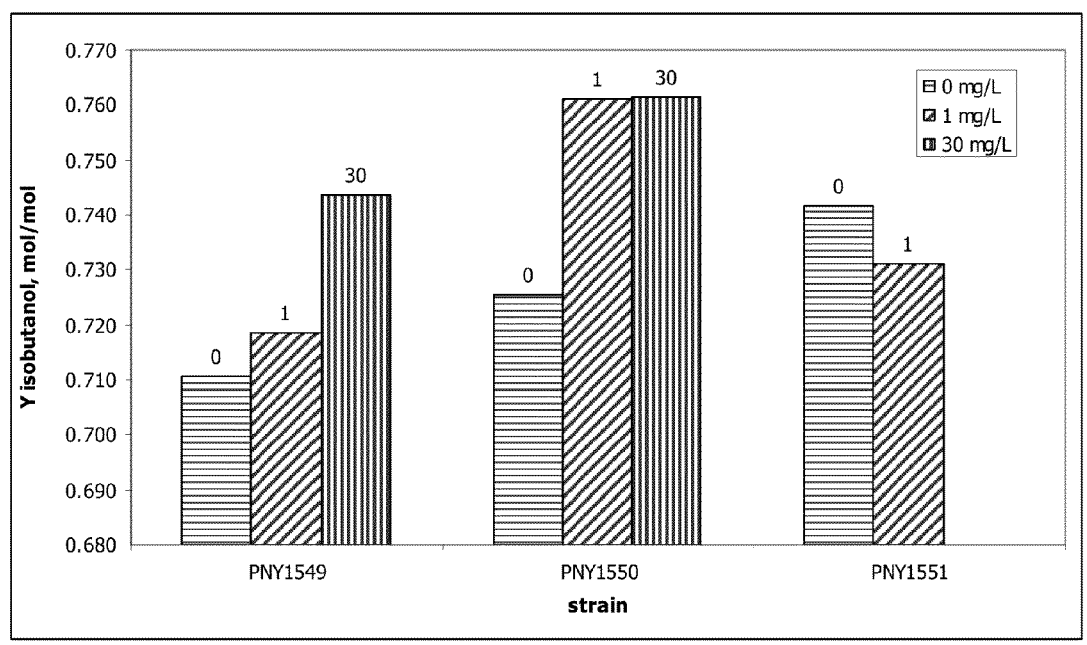

FIG. 2 demonstrates yields of α-ketoisovalerate and pyruvate in the presence of 0 mg/L, 1 mg/L and 30 mg/L thiamine for recombinant host cells as described in the Examples.

Figure 3:
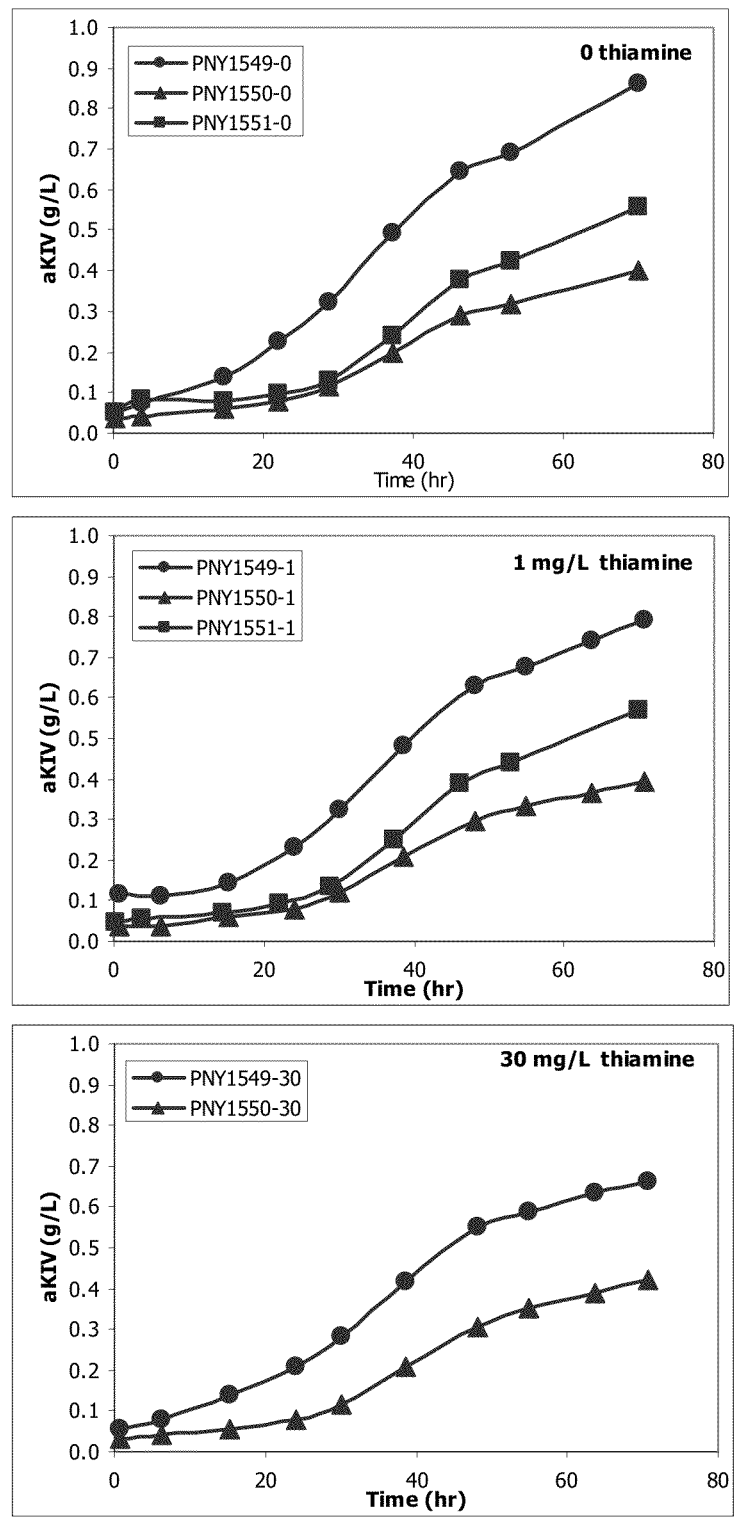

FIG. 3 shows the concentration of α-ketoisovalerate over the fermentation time for recombinant host cells in the presence of 0, 1 mg/L, and 30 mg/L thiamine as described in the Examples.

Table Z filed electronically herewith and incorporated by reference herein in its entirety is the KIVD cluster Profile HMM described herein. Table Z forms part of the specification.

The sequences provided in the sequence listing filed herewith (20120727_CL5253USNP_SEQ_ST25.txt; Size: 1,304,771 bytes; Creation date: Jul. 26, 2012), herein incorporated by reference, conform with 37 C.F.R. 1.821-1.825 ("Requirements for Patent Applications Containing Nucleotide Sequences and/or Amino Acid Sequence Disclosures—the Sequence Rules") and are consistent with the World Intellectual Property Organization (WIPO) Standard ST.25 (2009) and the sequence listing requirements of the EPO and PCT (Rules 5.2 and 49.5(α-βis), and Section 208 and Annex C of the Administrative Instructions). The symbols and format used for nucleotide and amino acid sequence data comply with the rules set forth in 37 C.F.R. §1.822.

DETAILED DESCRIPTION

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "isobutanol biosynthetic pathway" refers to the enzymatic pathway to produce isobutanol. From time to time "isobutanol biosynthetic pathway" is used synonymously with "isobutanol production pathway".

The term "carbon substrate" or "fermentable carbon substrate" refers to a carbon source capable of being metabolized by the recombinant host cells disclosed herein. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, one-carbon substrates or mixtures thereof.

The term "effective titer" as used herein, refers to the total amount of isobutanol produced by fermentation per liter of fermentation medium. The total amount of isobutanol includes: (i) the amount of isobutanol in the fermentation medium; (ii) the amount of isobutanol recovered from the fermentation medium, for example, by contact with an organic extractant; and (iii) the amount of isobutanol recovered from the gas phase, if gas stripping is used.

The term "effective rate" as used herein, refers to the total amount of isobutanol produced by fermentation per liter of fermentation medium per hour of fermentation.

The term "effective yield" as used herein, refers to the amount of isobutanol produced per unit of fermentable carbon substrate consumed by the biocatalyst.

The term "acetolactate synthase" refers to an enzyme that catalyzes the conversion of pyruvate to acetolactate and $CO_2$. Acetolactate has two stereoisomers ((R) and (S)); the enzyme prefers the (S)-isomer, which is made by biological systems. Acetolactate synthases may be classified as EC number 2.2.1.6 (*Enzyme Nomenclature* 1992, Academic Press, San Diego).

The term "ketol-acid reductoisomerase" (abbreviated "KARI"), and "acetohydroxy acid isomeroreductase" will be used interchangeably and refer to enzymes capable of catalyzing the reaction of (S)-acetolactate to 2,3-dihydroxyisovalerate. KARI enzymes may be classified as EC number EC 1.1.1.86 (*Enzyme Nomenclature* 1992, Academic Press, San Diego).

The terms "acetohydroxy acid dehydratase" and "dihydroxyacid dehydratase" (DHAD) refer to an enzyme that catalyzes the conversion of 2,3-dihydroxyisovalerate to α-ketoisovalerate. Acetohydroxy acid dehydratases may be classified as EC number 4.2.1.9 and are available from a vast array of microorganisms.

The term "branched-chain α-keto acid decarboxylase" or "α-ketoacid decarboxylase" or "α-ketoisovalerate decarboxylase" or "2-ketoisovalerate decarboxylase" (herein also referred to as ketoisovalerate decarboxylase or, from time to time, KIVD) refers to an enzyme that catalyzes the conversion of α-ketoisovalerate ("α-Kiv") to isobutyraldehyde and $CO_2$. Ketoisovalerate decarboxylase sequences are available from a number of microorganism sources, including those disclosed herein.

The term "branched-chain alcohol dehydrogenase" refers to an enzyme that catalyzes the conversion of isobutyraldehyde to isobutanol. Branched-chain alcohol dehydrogenases may be classified as EC number 1.1.1.265, but may also be classified under other alcohol dehydrogenases (specifically, EC 1.1.1.1 or 1.1.1.2).

The term "KIVD cluster Profile HMM" refers to the Profile Hidden Markov Model prepared as disclosed herein. The KIVD cluster Profile HMM is provided as Table Z.

The term "isolated nucleic acid molecule", "isolated nucleic acid fragment" and "genetic construct" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

The term "amino acid" refers to the basic chemical structural unit of a protein or polypeptide. The following abbreviations are used herein to identify specific amino acids:

TABLE 1

Amino Acids

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Leucine | Leu | L |
| Isoleucine | Ile | I |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of a microorganism. A "foreign" gene refers to a gene not normally found in the host microorganism, but that is introduced into the host microorganism by gene transfer. For example, foreign genes can comprise native genes inserted into a non-native microorganism, or chimeric genes. Foreign genes can also comprise, for example, native genes with mutations that change an amino acid residue of an encoded polypeptide. A "transgene" is a gene that has been introduced into the genome by a transformation procedure.

As used herein the term "coding sequence" refers to a DNA sequence that encodes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region with non-native regulatory regions that is reintroduced into the native host. A "transgene" is a gene that has been introduced into the genome by a transformation procedure.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths may have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths may have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into the genome of a host microorganism, resulting in genetically stable inheritance. Host microorganisms containing the transformed nucleic acid fragments are referred to as "transgenic" or "recombinant" or "transformed" microorganisms.

The terms "plasmid", "vector" and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "complementary" is used to describe the relationship between nucleotide bases that are capable of hybridizing to one another. For example, with respect to DNA, adenine is complementary to thymine and cytosine is complementary to guanine, and with respect to RNA, adenine is complementary to uracil and cytosine is complementary to guanine.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 2. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 2

The Standard Genetic Code

| | T | C | A | G |
|---|---|---|---|---|
| T | TTT Phe (F) | TCT Ser (S) | TAT Tyr (Y) | TGT Cys (C) |
| | TTC Phe (F) | TCC Ser (S) | TAC Tyr (Y) | TGC |
| | TTA Leu (L) | TCA Ser (S) | TAA Stop | TGA Stop |
| | TTG Leu (L) | TCG Ser (S) | TAG Stop | TGG Trp (W) |
| C | CTT Leu (L) | CCT Pro (P) | CAT His (H) | CGT Arg (R) |
| | CTC Leu (L) | CCC Pro (P) | CAC His (H) | CGC Arg (R) |
| | CTA Leu (L) | CCA Pro (P) | CAA Gln (Q) | CGA Arg (R) |
| | CTG Leu (L) | CCG Pro (P) | CAG Gln (Q) | CGG Arg (R) |

TABLE 2-continued

The Standard Genetic Code

|   | T | C | A | G |
|---|---|---|---|---|
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met (M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Given the large number of gene sequences available for a wide variety of animal, plant and microbial species, it is possible to calculate the relative frequencies of codon usage. Codon usage tables are readily available in the art, for example, at the "Codon Usage Database" available at http://www.kazusa.or.jp/codon/ (visited Mar. 20, 2008), and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 3. This table uses mRNA nomenclature, and so instead of thymine (T) which is found in DNA, the tables use uracil (U) which is found in RNA. Table 1B has been adapted so that frequencies are calculated for each amino acid, rather than for all 64 codons.

TABLE 3

Codon Usage Table for *Saccharomyces cerevisiae*

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |

TABLE 3-continued

Codon Usage Table for *Saccharomyces cerevisiae*

| Amino Acid | Codon | Number | Frequency per thousand |
|---|---|---|---|
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG-Wisconsin Package, available from Accelrys, Inc., San Diego, Calif. Constructing a rudimentary algorithm to assign codons based on a given frequency can also easily be accomplished with basic mathematical functions by one of ordinary skill in the art. Codon-optimized coding regions can be designed by various methods known to those skilled in the art including software packages such as "synthetic gene designer" (userpages.umbc.edu/~wug1/codon/sgd/, visited Mar. 19, 2012).

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as Basic Local Alignment Search Tool (BLAST) (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data. Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignments of the sequences is performed using the "Clustal method of alignment" which encompasses several varieties of the algorithm including the "Clustal V method of alignment" corresponding to the alignment method labeled Clustal V (described by Higgins and Sharp, *CABIOS*. 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS*. 5:151-153 (1989); Higgins, D. G. et al., *Comput. Appl. Biosci.* 8:189-191(1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, such as from other species, wherein such polypeptides have the same or similar function or activity, or in describing the corresponding polynucleotides. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotide fragments not only have the above homologies but typically comprise a polynucleotide having at least 50 nucleotides, at least 100 nucleotides, at least 150 nucleotides, at least 200 nucleotides, or at least 250 nucleotides. Further, suitable polynucleotide fragments having the above homologies encode a polypeptide having at least 50 amino acids, at least 100 amino acids, at least 150 amino acids, at least 200 amino acids, or at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.*, 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.](1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-lnterscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al. (2006) Yeast; 23(5):399-405), and gap repair methodology (Ma et al., *Genetics* 58:201-216; 1981).

As disclosed herein, Applicants have discovered polypeptides not previously annotated as α-ketoisovalerate decarboxylases polypeptides capable of catalyzing the substrate to product conversion of α-ketoisovalerate to isobutyraldehyde. Polynucleotides encoding the putative decarboxylases were synthesized, expressed in *E. coli*, and tested for α-ketoisovalerate decarboxylase activity. As shown in the examples, certain polypeptides were employed in recombinant host cells comprising an isobutanol biosynthetic pathway.

KIVD Polypeptides

Members of the protein family of ketoisovalerate decarboxylase (KIVD) were identified through National Center for Biotechnology Information (NCBI; www.ncbi.nlm.nih.gov, visited Jul. 27, 2012) BLAST searches of NCBI non-redundant (nr) protein database using amino acid sequences of *L. lactis* KivD (alpha-ketoisovalerate decarboxylase) (SEQ ID NO: 68), *L. lactis* KDCA (branched-chain keto acid decarboxylase) (SEQ ID NO: 66), *Enterobacter cloacae* IPDC (Indolepyruvate decarboxylase) (SEQ ID NO: 257) with the following search parameters: E value=10, word size=3, Matrix=Blosum62, and Gap opening=11 and gap extension=1, E value cutoff of $10^{-3}$. The three blast result sets were combined and sequences that are identical or whose lengths are greater than 712 or less than 583 were removed. This combined sequence set was then reduced to a set where the maximum identity between sequences is 65% ("nr65 set") using the program CD-Hit (downloaded January, 2007; available at weizhong-lab.ucsd.edu/cd-hit/, visited Jul. 25, 2012). The resulted in a set of 1184 KIVD sequences.

The 1184 sequences were aligned using ClustalW using all default parameters. A phylogenetic tree was then constructed from the multiple sequence alignment with neighbor-joining program using ClustalW. The phylogenetic tree was visualized using program iTOL (itol.embl.de, visited Jul. 27, 2012). A subtree of 180 sequences was selected which spanned over *L. Lactis* KivD, *E. cloacae* IPDC, *S. cerevisiae* PDC (pyruvate decarboxylase) and *Zymomonas* PDC and their close homologs. This subset was then expanded to include all cluster members in the nr65 set of these 180 sequences. The final set consisted of 601 sequences and was used to construct the sequence similarity network as described below.

The sequence similarity network consisted of a collection of edges corresponding to pairwise relationships that are better than a defined threshold (Atkinson H J et al. PLoS One. 2009, 4:e4345). For the analysis here, pairwise relationships correspond to BLAST alignments associated with an E-value. The set of 601 sequences were used to create a custom BLAST database using 'formatdb' (NCBI; www.ncbi.nlm.nih.gov/BLAST/docs/formatdb.html; visited Jul. 26, 2012). Then each sequence in the set was searched against this database using BLAST. Since BLAST E-values are not symmetric, the best E-value was kept and associated with each pairwise comparison.

All pairwise alignments that were better than E-value threshold of E-130 were loaded into program Cytoscape (www.cytoscape.org; visited Jul. 27, 2012), and a graph was generated using the Organic layout algorithm. Upon visualization, these 601 sequences fell into discernable clusters. One cluster containing 170 sequences was identified to contain *L. lactis* KivD, *L. lactis* KDCA, and *E. cloacae* IPDC. Since *L. lactis* KivD and *L. lactis* KDCA are known α-ketoisovalerate decarboxylases, several candidates from this cluster were selected for the diversity selection. Certain sequences from this cluster were experimentally verified as shown herein to have α-ketoisovalerate decarboxylase activity (See Examples 3 and 5).

Because the cluster was verified to contain polypeptides with □-ketoisovalerate decarboxylase activity, a profile HMM for the KIVD cluster was generated from the set of 170 sequences described above and provided in Table 4. The % identity, as determined from the multiple sequence alignment by ClustalW, of the cluster sequences to sequences verified experimentally to have □-etoisovalerate decarboxylase activity is provided in Table 4. One of skill in the art will appreciate that polypeptides provided in Table 4 are candidate polypeptides for embodiments provided herein and can readily make and test the polypeptides for ☐-ketoacid decarboxylase activity. Accordingly source organisms provided in Table 4 may be source organisms for polypeptides suitable for embodiments provided herein. Thus, provided herein are methods for converting α-ketoisovalerate to isobutyraldehyde comprising providing a polypeptide comprising SEQ ID NO: 51, 52, 53, 55, 56, 58, 59, 61, 63, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, or 416 (or a polypeptide having at least 80%, 85%, 90%, 95%, or 98% identity thereto or an active fragment thereof) and contacting said polypeptide with α-ketoisovalerate under conditions wherein isobutyraldehyde is produced. In some embodiments, said contacting occurs within a recombinant host cell. In some embodiments, said host cell comprises an isobutanol biosynthetic pathway. In some embodiments, recombinant host cells comprise a polynucleotide encoding a polypeptide of Table 4, or a polypeptide having at least 80%, at least 85%, at least 90%, at least 95%, or at least 98% identity thereto, or an active fragment thereof. Provided herein are methods for producing isobutanol comprising providing a recombinant host cell comprising a polypeptide comprising SEQ ID NO: 51, 52, 53, 55, 56, 58, 59, 61, 63, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, or 416 (or a polypeptide having at least 80%, 85%, 90%, 95%, or 98% identity thereto or an active fragment thereof) and contacting said polypeptide with α-ketoisovalerate under conditions wherein isobutyraldehyde is produced.

TABLE 4

| Percent Identity of KIVD cluster sequences | | | | | | | | | | | |
|---|---|---|---|---|---|---|---|---|---|---|---|
| | | | Identity to SEQ ID NO: (GI number) | | | | | | | | |
| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
| gi\|228943180\| ref\|ZP_04105648.1 | *Bacillus thuringiensis* serovar berliner ATCC 10792 | 328 | 36% | 43% | 93% | 40% | 38% | 62% | 50% | 44% | 40% |
| gi\|229145075\| ref\|ZP_04273468.1 | *Bacillus cereus* BDRD-ST24 | 342 | 37% | 44% | 94% | 40% | 39% | 62% | 50% | 44% | 41% |
| gi\|229044211\| ref\|ZP_04191886.1 | *Bacillus cereus* AH676 | 333 | 37% | 43% | 94% | 40% | 39% | 62% | 50% | 44% | 41% |
| gi\|229069982\| ref\|ZP_04203259.1 | *Bacillus cereus* F65185 | 334 | 36% | 44% | 91% | 40% | 38% | 63% | 49% | 44% | 41% |
| gi\|229079646\| ref\|ZP_04212180.1 | *Bacillus cereus* Rock4-2 | 335 | 36% | 43% | 92% | 40% | 38% | 63% | 49% | 44% | 41% |
| gi\|206971696\| ref\|ZP_03232646.1 | *Bacillus cereus* AH1134 | 306 | 36% | 44% | 92% | 40% | 38% | 63% | 49% | 44% | 41% |
| gi\|228952828\| ref\|ZP_04114898.1 | *Bacillus thuringiensis* serovar kurstaki str. T03a001 | 330 | 36% | 43% | 92% | 40% | 38% | 62% | 49% | 43% | 41% |
| gi\|229181920\| ref\|ZP_04309225.1 | *Bacillus cereus* 172560W | 346 | 36% | 43% | 93% | 40% | 38% | 63% | 49% | 44% | 41% |
| gi\|229109914\| ref\|ZP_04239496.1 | *Bacillus cereus* Rock1-15 | 338 | 37% | 43% | 92% | 40% | 38% | 62% | 50% | 44% | 41% |
| gi\|218230913\| ref\|YP_002367156. | *Bacillus cereus* B4264 | 312 | 36% | 43% | 91% | 40% | 39% | 63% | 49% | 44% | 41% |
| gi\|30020564\| ref\|NP_832195.1\| | *Bacillus cereus* ATCC 14579 | 398 | 37% | 44% | 92% | 40% | 39% | 62% | 50% | 44% | 41% |
| gi\|229127869\| ref\|ZP_04256855.1 | *Bacillus cereus* BDRD-Cer4 | 341 | 37% | 44% | 92% | 40% | 39% | 62% | 49% | 44% | 41% |
| gi\|229150678\| ref\|ZP_04278892.1 | *Bacillus cereus* m1550 | 343 | 37% | 43% | 94% | 40% | 39% | 62% | 50% | 44% | 41% |
| gi\|229190623\| ref\|ZP_04317620.1 | *Bacillus cereus* ATCC 10876 | 347 | 36% | 44% | 93% | 40% | 39% | 63% | 50% | 44% | 40% |
| gi\|228908218\| ref\|ZP_04072064.1 | *Bacillus thuringiensis* IBL 200 | 53 | 37% | 44% | 100% | 40% | 39% | 63% | 50% | 44% | 41% |
| gi\|30262484\| ref\|NP_844861.1\| | *Bacillus anthracis* str. Ames | 399 | 37% | 44% | 90% | 40% | 38% | 62% | 50% | 44% | 42% |
| gi\|170704700\| ref\|ZP_02895166.1 | *Bacillus anthracis* str. A0389 | 293 | 37% | 44% | 89% | 40% | 38% | 63% | 50% | 44% | 42% |

TABLE 4-continued

| Percent Identity of KIVD cluster sequences | | | | | | | | | | | |
|---|---|---|---|---|---|---|---|---|---|---|---|
| | | | Identity to SEQ ID NO: (GI number) | | | | | | | | |
| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
| gi\|165868862\| \|ref\|ZP_02213522.1 | *Bacillus anthracis* str. A0488 | 283 | 37% | 44% | 89% | 40% | 38% | 63% | 51% | 44% | 42% |
| gi\|228946089\| ref\|ZP_04108425.1 | *Bacillus thuringiensis* serovar monterrey BGSC 4AJ1 | 329 | 38% | 44% | 90% | 41% | 38% | 63% | 50% | 45% | 42% |
| gi\|49477724\| ref\|YP_036605.1\| | *Bacillus thuringiensis* serovar *konkukian* str. 97-27 | 404 | 38% | 45% | 91% | 41% | 39% | 63% | 51% | 45% | 42% |
| gi\|228933783\| ref\|ZP_04096629.1 | *Bacillus thuringiensis* serovar andalousiensis BGSC 4AW1 | 327 | 38% | 44% | 90% | 41% | 39% | 63% | 51% | 45% | 42% |
| gi\|196033775\| ref\|ZP_03101186.1 | *Bacillus cereus* W | 300 | 38% | 45% | 90% | 41% | 39% | 64% | 51% | 45% | 42% |
| gi\|218903623\| ref\|YP_002451457. | *Bacillus cereus* AH820 | 313 | 38% | 45% | 90% | 41% | 39% | 64% | 51% | 45% | 42% |
| gi\|229122031\| ref\|ZP_04251247.1 | *Bacillus cereus* 95/8201 | 340 | 38% | 44% | 91% | 41% | 39% | 63% | 51% | 45% | 42% |
| gi\|52143006\| ref\|YP_083823.1\| | *Bacillus cereus* E33L | 408 | 38% | 45% | 90% | 41% | 39% | 63% | 51% | 45% | 42% |
| gi\|228915074\| ref\|ZP_04078671.1 | *Bacillus thuringiensis* serovar pulsiensis BGSC 4CC1 | 326 | 38% | 44% | 90% | 41% | 38% | 63% | 51% | 45% | 42% |
| gi\|229196690\| ref\|ZP_04323433.1 | *Bacillus cereus* m1293 | 348 | 38% | 44% | 91% | 41% | 39% | 63% | 51% | 45% | 42% |
| gi\|217959977\| ref\|YP_002338533. | *Bacillus cereus* AH187 | 311 | 38% | 44% | 89% | 41% | 39% | 63% | 51% | 46% | 42% |
| gi\|206973990\| ref\|ZP_03234908.1 | *Bacillus* cereus H3081.97 | 307 | 37% | 44% | 89% | 41% | 39% | 63% | 51% | 45% | 42% |
| gi\|222096064\| ref\|YP_002530121. | *Bacillus cereus* Q1 | 315 | 38% | 44% | 90% | 41% | 39% | 63% | 51% | 45% | 42% |
| gi\|228985570\| ref\|ZP_04145724.1 | *Bacillus thuringiensis* serovar tochigiensis BGSC 4Y1 | 331 | 37% | 44% | 90% | 40% | 39% | 62% | 51% | 45% | 42% |
| gi\|229156064\| ref\|ZP_04284163.1 | *Bacillus cereus* ATCC 4342 | 344 | 37% | 43% | 89% | 40% | 39% | 61% | 50% | 45% | 42% |

TABLE 4-continued

Percent Identity of KIVD cluster sequences

| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
|---|---|---|---|---|---|---|---|---|---|---|---|
| gi\|47570048\|ref\|ZP_00240709.1\| | Bacillus cereus G9241 | 403 | 37% | 43% | 90% | 40% | 39% | 63% | 50% | 45% | 41% |
| gi\|229173153\|ref\|ZP_04300703.1\| | Bacillus cereus MM3 | 345 | 37% | 44% | 91% | 41% | 39% | 62% | 50% | 44% | 42% |
| gi\|229030189\|ref\|ZP_04186249.1\| | Bacillus cereus AH1271 | 332 | 38% | 44% | 90% | 41% | 39% | 63% | 50% | 44% | 42% |
| gi\|42781579\|ref\|NP_978826.1\| | Bacillus cereus ATCC 10987 | 401 | 37% | 44% | 90% | 40% | 39% | 62% | 51% | 44% | 42% |
| gi\|229100258\|ref\|ZP_04231149.1\| | Bacillus cereus Rock3-29 | 336 | 37% | 44% | 86% | 41% | 40% | 63% | 50% | 46% | 42% |
| gi\|229115945\|ref\|ZP_04245341.1\| | Bacillus cereus Rock1-3 | 339 | 37% | 44% | 87% | 41% | 40% | 63% | 50% | 46% | 42% |
| gi\|229103080\|ref\|ZP_04233768.1\| | Bacillus cereus Rock3-28 | 337 | 38% | 44% | 88% | 41% | 40% | 63% | 50% | 45% | 42% |
| gi\|294497944\|ref\|YP_003561644. | Bacillus megaterium QM B1551 | 58 | 40% | 44% | 63% | 42% | 41% | 100% | 50% | 48% | 44% |
| gi\|15004729\|ref\|NP_149189.1\| | Clostridium acetobutylicum ATCC 824 | 266 | 40% | 44% | 61% | 41% | 41% | 69% | 48% | 44% | 43% |
| gi\|186682481\|ref\|YP_001865677. | Nostoc punctiforme PCC 73102 | 297 | 37% | 39% | 48% | 38% | 35% | 48% | 44% | 40% | 35% |
| gi\|16417060\|gb\|AAL18557.1\|AF35 | Sarcina ventriculi | 63 | 34% | 38% | 41% | 35% | 35% | 44% | 48% | 41% | 100% |
| gi\|291276462\|ref\|YP_003516234. | Helicobacter mustelae 12198 | 59 | 39% | 40% | 50% | 41% | 39% | 50% | 100% | 44% | 48% |
| gi\|27469128\|ref\|NP_765765.1\| | Staphylococcus epidermidis ATCC 12228 | 381 | 35% | 44% | 44% | 36% | 38% | 46% | 43% | 66% | 40% |
| gi\|251811671\|ref\|ZP_04826144.1\| | Staphylococcus epidermidis BCM-HMP0060 | 361 | 35% | 44% | 44% | 36% | 38% | 46% | 43% | 66% | 40% |
| gi\|242243554\|ref\|ZP_04797999.1\| | Staphylococcus epidermidis W23144 | 359 | 34% | 44% | 43% | 36% | 38% | 47% | 42% | 65% | 39% |
| gi\|242372336\|ref\|ZP_04817910.1\| | Staphylococcus epidermidis M23864:W1 | 360 | 34% | 43% | 44% | 35% | 38% | 46% | 41% | 65% | 39% |
| gi\|223044198\|ref\|ZP_03614236.1\| | Staphylococcus capitis SK14 | 316 | 34% | 44% | 44% | 35% | 38% | 47% | 41% | 64% | 40% |
| gi\|239637821\| | Staphylococcus | 358 | 34% | 43% | 43% | 35% | 39% | 46% | 41% | 67% | 39% |

TABLE 4-continued

Percent Identity of KIVD cluster sequences

| KIVD cluster member | Source organism | Cluster Member SEQ ID NO: | Identity to SEQ ID NO: (GI number) | | | | | | | | | |
|---|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| ref\|ZP_04678783.1\| gi\|289549575\| ref\|YP_003470479. | *warneri* L37603 *Staphylococcus lugdunensis* HKU09-01 | 389 | 35% | 46% | 45% | 37% | 39% | 46% | 42% | 65% | 39% |
| gi\|253734750\| ref\|ZP_04868915.1\| | *Staphylococcus aureus* subsp. *aureus* TCH130 | 364 | 34% | 44% | 44% | 35% | 39% | 45% | 41% | 65% | 39% |
| gi\|212818911\| ref\|NP_644977.1\| | *Staphylococcus aureus* subsp. *aureus* MW2 | 308 | 34% | 45% | 44% | 35% | 39% | 45% | 41% | 65% | 39% |
| gi\|283469432\| emb\|CAQ48643.1\| | *Staphylococcus aureus* subsp. *aureus* ST398 | 384 | 34% | 44% | 44% | 35% | 39% | 45% | 41% | 65% | 39% |
| gi\|253730541\| ref\|ZP_04864706.1\| | *Staphylococcus aureus* subsp. *aureus* USA300_TCH959 | 363 | 34% | 44% | 44% | 35% | 39% | 45% | 41% | 65% | 40% |
| gi\|57651189\| ref\|YP_185072.1\| | *Staphylococcus aureus* subsp. *aureus* COL | 410 | 34% | 44% | 43% | 35% | 39% | 45% | 41% | 66% | 40% |
| gi\|15923178\| ref\|NP_370712.1\| | *Staphylococcus aureus* subsp. *aureus* Mu50 | 280 | 34% | 44% | 43% | 36% | 38% | 45% | 41% | 65% | 40% |
| gi\|148266613\| ref\|YP_001245556. | *Staphylococcus aureus* subsp. *aureus* JH9 | 264 | 34% | 44% | 43% | 36% | 38% | 45% | 41% | 65% | 39% |
| gi\|227898330\| ref\|ZP_04016135.1\| | *Staphylococcus aureus* subsp. *aureus* TCH60 | 324 | 33% | 44% | 44% | 35% | 39% | 45% | 41% | 65% | 40% |
| gi\|49482430\| ref\|YP_039654.1\| | *Staphylococcus aureus* subsp. *aureus* MRSA252 | 405 | 33% | 44% | 44% | 35% | 39% | 45% | 41% | 65% | 39% |
| gi\|221138844\| ref\|ZP_03563646.1\| | *Staphylococcus aureus* subsp. *aureus* str. JKD6008 | 314 | 33% | 44% | 44% | 35% | 39% | 45% | 41% | 65% | 40% |
| gi\|227556295\| ref\|ZP_03986342.1\| | *Staphylococcus aureus* subsp. *aureus* MN8 | 322 | 33% | 44% | 44% | 35% | 39% | 45% | 41% | 65% | 40% |
| gi\|282915516\| ref\|ZP_06323288.1\| | *Staphylococcus aureus* subsp. *aureus* D139 | 383 | 34% | 44% | 43% | 36% | 38% | 45% | 41% | 65% | 39% |
| gi\|283767927\| ref\|ZP_06340842.1\| | *Staphylococcus aureus* subsp. *aureus* H19 | 385 | 34% | 44% | 44% | 35% | 38% | 45% | 41% | 65% | 39% |
| gi\|82749898\| | *Staphylococcus* | 414 | 34% | 44% | 44% | 35% | 38% | 45% | 41% | 65% | 39% |

TABLE 4-continued

Percent Identity of KIVD cluster sequences

| KIVD cluster member | Source organism | Cluster Member SEQ ID NO: | Identity to SEQ ID NO: (GI number) | | | | | | | | | |
|---|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| ref|YP_415639.1| | *aureus* RF122 | 368 | 34% | 44% | 44% | 35% | 38% | 45% | 41% | 66% | 39% |
| gi|258424299| ref|ZP_05687180.1| | *Staphylococcus aureus* A9635 | 325 | 33% | 45% | 45% | 35% | 38% | 47% | 41% | 66% | 41% |
| gi|228475763| ref|ZP_04060481.1| | *Staphylococcus hominis* SK119 | 412 | 33% | 44% | 45% | 34% | 37% | 48% | 42% | 67% | 41% |
| gi|70725377| ref|YP_252291.1| | *Staphylococcus haemolyticus* JCSC1435 | 317 | 36% | 46% | 44% | 37% | 39% | 47% | 42% | 64% | 40% |
| gi|224477650| ref|YP_002635256. | *Staphylococcus carnosus* subsp. *carnosus* TM300 | 413 | 34% | 44% | 45% | 34% | 38% | 47% | 42% | 62% | 38% |
| gi|73661481| ref|YP_300262.1| | *Staphylococcus saprophyticus* subsp. *saprophyticus* ATCC 15305 | 61 | 36% | 45% | 44% | 36% | 37% | 48% | 44% | 100% | 41% |
| gi|222151578| ref|YP_002560734. | *Macrococcus caseolyticus* JCSC5402 | 382 | 36% | 45% | 44% | 37% | 39% | 44% | 43% | 46% | 38% |
| gi|281491840| ref|YP_003353820. | *Lactococcus lactis* subsp. *lactis* KF147 | 407 | 36% | 45% | 44% | 38% | 39% | 44% | 42% | 46% | 37% |
| gi|51870502| emb|CAG34226.1| | *Lactococcus lactis* subsp. *lactis* | 272 | 30% | 37% | 36% | 31% | 31% | 36% | 35% | 37% | 31% |
| gi|156732286| ref|NP_267460.1| | *Lactococcus lactis* subsp. *lactis* Il1403 | 402 | 37% | 45% | 45% | 39% | 38% | 44% | 44% | 45% | 38% |
| gi|44921617| gb|AAS49166.1| | *Lactococcus lactis* | 52 | 35% | 100% | 44% | 37% | 39% | 44% | 40% | 45% | 38% |
| gi|229556973| ref|ZP_04444762.1| | *Listeria grayi* DSM 20601 | 275 | 31% | 36% | 40% | 33% | 32% | 42% | 38% | 34% | 36% |
| gi|157369235| ref|YP_001477224. | *Serratia proteamaculans* 568 | 380 | 31% | 36% | 40% | 33% | 32% | 41% | 38% | 34% | 36% |
| gi|270263480| ref|ZP_06191749.1| | *Serratia odorifera* 4Rx13 | 393 | 31% | 36% | 40% | 33% | 31% | 40% | 37% | 35% | 35% |
| gi|293392629| ref|ZP_06636949.1| | *Serratia odorifera* DSM 4582 | 367 | 35% | 36% | 42% | 36% | 33% | 40% | 38% | 37% | 35% |
| gi|255318365| ref|ZP_05359598.1 | *Acinetobacter radioresistens* SK82 | | | | | | | | | | |

TABLE 4-continued

Percent Identity of KIVD cluster sequences

| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
|---|---|---|---|---|---|---|---|---|---|---|---|
| gi\|262378595\|ref\|ZP_06071752.1 | Acinetobacter radioresistens SH164 | 378 | 35% | 36% | 42% | 36% | 33% | 40% | 38% | 37% | 35% |
| gi\|126642486\|ref\|YP_001085470. | Acinetobacter baumannii ATCC 17978 | 261 | 27% | 30% | 35% | 28% | 27% | 33% | 29% | 30% | 28% |
| gi\|215482721\|ref\|YP_002324919. | Acinetobacter baumannii AB307-0294 | 310 | 33% | 36% | 42% | 34% | 33% | 40% | 37% | 36% | 34% |
| gi\|260556653\|ref\|ZP_05828871.1 | Acinetobacter baumannii ATCC 19606 | 373 | 33% | 36% | 42% | 34% | 33% | 40% | 37% | 36% | 34% |
| gi\|184158976\|ref\|YP_001847315. | Acinetobacter baumannii ACICU | 295 | 33% | 36% | 42% | 34% | 33% | 40% | 37% | 36% | 34% |
| gi\|169795173\|ref\|YP_001712966. | Acinetobacter baumannii AYE | 292 | 33% | 36% | 42% | 34% | 33% | 40% | 37% | 36% | 34% |
| gi\|239501136\|ref\|ZP_04660446.1 | Acinetobacter baumannii AB900 | 357 | 32% | 36% | 41% | 33% | 32% | 39% | 37% | 35% | 33% |
| gi\|293609760\|ref\|ZP_06692062.1 | Acinetobacter sp. SH024 | 395 | 33% | 36% | 42% | 34% | 33% | 40% | 37% | 36% | 34% |
| gi\|260549701\|ref\|ZP_05823918.1 | Acinetobacter sp. RUH2624 | 372 | 33% | 36% | 42% | 34% | 33% | 40% | 37% | 36% | 34% |
| gi\|169632867\|ref\|ZP_01706603. | Acinetobacter baumannii SDF | 291 | 35% | 35% | 38% | 35% | 34% | 40% | 36% | 36% | 33% |
| gi\|262278264\|ref\|ZP_06056049.1 | Acinetobacter calcoaceticus RUH2202 | 377 | 36% | 35% | 37% | 35% | 34% | 39% | 36% | 34% | 32% |
| gi\|91779968\|ref\|YP_555176.1 | Burkholderia xenovorans LB400 | 415 | 35% | 38% | 39% | 36% | 33% | 38% | 37% | 37% | 37% |
| gi\|116695342\|ref\|YP_840918.1 | Ralstonia eutropha H16 | 256 | 35% | 38% | 38% | 37% | 32% | 37% | 38% | 36% | 37% |
| gi\|227506048\|ref\|ZP_03936097.1 | Corynebacterium striatum ATCC 6940 | 321 | 39% | 35% | 36% | 40% | 35% | 35% | 34% | 33% | 32% |
| gi\|227831961\|ref\|YP_002833668. | Corynebacterium aurimucosum ATCC 700975 | 323 | 36% | 33% | 34% | 38% | 34% | 33% | 31% | 32% | 30% |
| gi\|157876137\|ref\|XP_001686429. | Leishmania major strain Friedlin | 277 | 38% | 34% | 35% | 39% | 35% | 35% | 35% | 34% | 32% |
| gi\|146099506\|ref\|XP_001468661. | Leishmania infantum JPCM5 | 262 | | | | | | | | | |
| gi\|154336655\| | Leishmania | 269 | | | | | | | | | |

TABLE 4-continued

Percent Identity of KIVD cluster sequences

| KIVD cluster member | Source organism | Cluster Member SEQ ID NO: | Identity to SEQ ID NO: (GI number) | | | | | | | | |
|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| ref|XP_001564563. | braziliensis MHOM/BR/75/M2904 | 355 | | | | | | | | | |
| gi|238958711| ref|YP_002920607. | Klebsiella pneumoniae NTUH-K2044 | 376 | 43% | 38% | 43% | 45% | 42% | 43% | 41% | 37% | 35% |
| gi|262042017| ref|ZP_06015197.1 | Klebsiella pneumoniae subsp. rhinoscleromatis ATCC 13884 | 268 | 43% | 38% | 42% | 45% | 42% | 42% | 40% | 37% | 34% |
| gi|152971277| ref|YP_001336386. | Klebsiella pneumoniae subsp. pneumoniae MGH 78578 | 388 | 43% | 38% | 43% | 45% | 42% | 42% | 40% | 37% | 34% |
| gi|288934189| ref|YP_003438248. | Klebsiella variicola At-22 | 390 | 43% | 39% | 42% | 44% | 43% | 42% | 41% | 37% | 34% |
| gi|290508392| ref|ZP_06547763.1 | Klebsiella sp. 1_1_55 | 305 | 42% | 39% | 42% | 44% | 43% | 42% | 41% | 37% | 34% |
| gi|206579495| ref|YP_002237253. | Klebsiella pneumoniae 342 | 349 | 43% | 38% | 40% | 44% | 42% | 42% | 40% | 37% | 35% |
| gi|237732391| ref|ZP_04562872.1 | Citrobacter sp. 30_2 | 387 | 44% | 38% | 42% | 46% | 42% | 42% | 41% | 37% | 34% |
| gi|283832207| ref|ZP_06351948.1 | Citrobacter youngae ATCC 29220 | 274 | 44% | 38% | 40% | 46% | 42% | 42% | 41% | 36% | 35% |
| gi|157144683| ref|YP_001452002. | Citrobacter koseri ATCC BAA-895 | 386 | 43% | 40% | 41% | 45% | 41% | 41% | 41% | 35% | 35% |
| gi|283786472| ref|YP_003366337. | Citrobacter rodentium ICC168 | 284 | 43% | 38% | 41% | 45% | 41% | 41% | 41% | 35% | 36% |
| gi|167613311| ref|NP_456948.1| | Salmonella enterica subsp. enterica serovar Typhi str. CT18 | 309 | 39% | 35% | 37% | 41% | 38% | 37% | 38% | 33% | 33% |
| gi|213583505| ref|ZP_03653311.1 | Salmonella enterica subsp. enterica serovar Typhi str. E98-0664 | 282 | 43% | 38% | 41% | 45% | 41% | 41% | 41% | 36% | 36% |
| gi|161612850| ref|YP_001586815. | Salmonella enterica subsp. | | | | | | | | | | |

TABLE 4-continued

Percent Identity of KIVD cluster sequences

| KIVD cluster member | Source organism | Cluster Member SEQ ID NO: | Identity to SEQ ID NO: (GI number) | | | | | | | | |
|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| gi\|176576731\| ref\|NP_461346.1\| | Salmonella enterica serovar Paratyphi B str. SPB7 | 285 | 43% | 38% | 41% | 45% | 41% | 41% | 41% | 36% | 36% |
| gi\|197247765\| ref\|YP_002147363. | Salmonella enterica subsp. enterica serovar Typhimurium str. LT2 | 301 | 43% | 38% | 41% | 45% | 41% | 41% | 41% | 36% | 36% |
| gi\|168242551\| ref\|ZP_02667483.1 | Salmonella enterica subsp. enterica serovar Agona str. SL483 | 288 | 43% | 39% | 41% | 45% | 41% | 41% | 41% | 36% | 36% |
| gi\|224583057\| ref\|YP_002636855. | Salmonella enterica subsp. enterica serovar Heidelberg str. SL486 | 318 | 43% | 38% | 41% | 45% | 41% | 41% | 41% | 36% | 36% |
| gi\|205353519\| ref\|YP_002227320. | Salmonella enterica subsp. enterica serovar Paratyphi C strain RKS4594 | 304 | 43% | 39% | 41% | 45% | 41% | 41% | 41% | 36% | 36% |
| gi\|62180978\| ref\|YP_217395.1\| | Salmonella enterica subsp. enterica serovar Choleraesuis str. SC-B67 | 411 | 43% | 38% | 41% | 45% | 41% | 41% | 41% | 36% | 36% |

TABLE 4-continued

| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
|---|---|---|---|---|---|---|---|---|---|---|---|
| gi\|168261562\|ref\|ZP_02683535.1 | Salmonella enterica subsp. enterica serovar Hadar str. RL_05P066 | 289 | 43% | 39% | 41% | 45% | 41% | 41% | 41% | 36% | 36% |
| gi\|168817849\|ref\|ZP_02829849.1 | Salmonella enterica subsp. enterica serovar Weltevreden str. HI_N05-537 | 290 | 43% | 38% | 41% | 45% | 41% | 41% | 41% | 35% | 36% |
| gi\|200388821\|ref\|ZP_03215433.1 | Salmonella enterica subsp. enterica serovar Virchow str. SL491 | 302 | 43% | 38% | 41% | 45% | 41% | 41% | 41% | 35% | 36% |
| gi\|204929204\|ref\|ZP_03220347.1 | Salmonella enterica subsp. enterica serovar Javiana str. GA_MM04042433 | 303 | 43% | 38% | 42% | 45% | 41% | 41% | 41% | 35% | 36% |
| gi\|168237435\|ref\|ZP_02662493.1 | Salmonella enterica subsp. enterica serovar Schwarzengrund str. SL480 | 287 | 43% | 38% | 41% | 45% | 41% | 41% | 41% | 35% | 36% |
| gi\|238912825\|ref\|ZP_04656662.1 | Salmonella enterica subsp. enterica serovar Tennessee str. CDC07-0191 | 356 | 43% | 38% | 41% | 45% | 41% | 41% | 41% | 35% | 36% |
| gi\|168229788\|ref\|ZP_02654846.1 | Salmonella enterica subsp. | 286 | 43% | 38% | 41% | 45% | 41% | 41% | 41% | 35% | 36% |

TABLE 4-continued

Percent Identity of KIVD cluster sequences

| KIVD cluster member | Source organism | Cluster Member SEQ ID NO: | Identity to SEQ ID NO: (GI number) | | | | | | | | |
|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| gi\|56412697\| ref\|YP_149772.1\| | Salmonella enterica subsp. enterica serovar Kentucky str. CDC 191 | 409 | 43% | 38% | 41% | 45% | 41% | 41% | 41% | 35% | 36% |
| gi\|161502438\| ref\|YP_001569550. | "Salmonella enterica subsp. arizonae serovar Paratyphi A str. ATCC 9150 62:z4, z23:—" | 281 | 42% | 38% | 41% | 44% | 41% | 41% | 41% | 36% | 36% |
| gi\|118333\|sp\| P23234\|DCIP_ENTCL | Enterobacter cloacae | 257 | 43% | 36% | 42% | 45% | 42% | 43% | 42% | 37% | 37% |
| gi\|18652678\| gb\|AAG00523.2\| AF28 | Enterobacter cloacae | 296 | 43% | 36% | 42% | 45% | 42% | 43% | 42% | 37% | 37% |
| gi\|295058524\| gb\|ADF63262.1\| | Enterobacter cloacae subsp. cloacae ATCC 13047 | 396 | 42% | 37% | 42% | 44% | 43% | 42% | 43% | 37% | 38% |
| gi\|261340738\| ref\|ZP_05968596.1 | Enterobacter cancerogenus ATCC 35316 | 375 | 42% | 37% | 41% | 44% | 41% | 42% | 43% | 37% | 37% |
| gi\|295098023\| emb\|CBK87113.1\| | Enterobacter cloacae NCTC 9394 | 397 | 43% | 37% | 41% | 45% | 42% | 42% | 43% | 37% | 37% |
| gi\|146312564\| ref\|YP_001177638. | Enterobacter sp. 638 | 263 | 43% | 36% | 40% | 45% | 43% | 41% | 41% | 37% | 37% |
| gi\|156933042\| ref\|YP_001436958. | Cronobacter sakazakii ATCC BAA-894 | 273 | 45% | 36% | 40% | 47% | 42% | 41% | 40% | 34% | 34% |
| gi\|260598789\| ref\|YP_003211360. | Cronobacter turicensis z3032 | 374 | 44% | 36% | 39% | 46% | 42% | 41% | 40% | 34% | 34% |
| gi\|291618298\| ref\|YP_003521040. | Pantoea ananatis LMG 20103 | 391 | 42% | 37% | 41% | 43% | 41% | 43% | 37% | 37% | 33% |
| gi\|1507711\| gb\|AAB06571.1\| | Pantoea agglomerans | 267 | 44% | 40% | 42% | 45% | 43% | 44% | 41% | 38% | 35% |
| gi\|258634877\| ref\|ZP_05727642.1 | Pantoea sp. At-9b | 369 | 45% | 38% | 42% | 47% | 43% | 43% | 41% | 38% | 36% |

TABLE 4-continued

| KIVD cluster member | Source organism | Cluster Member SEQ ID NO: | Percent Identity of KIVD cluster sequences — Identity to SEQ ID NO: (GI number) | | | | | | | | |
|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| gi|292488940| ref|YP_003531827. | *Erwinia amylovora* CFBP1430 | 392 | 46% | 38% | 43% | 48% | 43% | 44% | 39% | 36% | 34% |
| gi|259907830| ref|YP_002648186. | *Erwinia pyrifoliae* Ep1/96 | 371 | 46% | 38% | 43% | 48% | 43% | 44% | 39% | 36% | 35% |
| gi|188533259| ref|YP_001907056. | *Erwinia tasmaniensis* Et1/99 | 298 | 46% | 37% | 42% | 48% | 44% | 44% | 41% | 35% | 35% |
| gi|50122526| ref|YP_051693.1| | *Pectobacterium atrosepticum* SCRI1043 | 406 | 44% | 40% | 43% | 44% | 42% | 44% | 42% | 39% | 35% |
| gi|227112359| ref|ZP_03826015.1 | *Pectobacterium carotovorum* subsp. *brasiliensis* PBR1692 | 319 | 44% | 40% | 42% | 44% | 42% | 45% | 42% | 39% | 36% |
| gi|253689788| ref|YP_003018978. | *Pectobacterium carotovorum* subsp. *carotovorum* PC1 | 362 | 44% | 40% | 43% | 44% | 42% | 45% | 41% | 38% | 35% |
| gi|270262920| ref|ZP_06191191.1 | *Serratia odorifera* 4Rx13 | 379 | 44% | 38% | 41% | 46% | 41% | 43% | 38% | 37% | 35% |
| gi|157371649| ref|YP_001479638. | *Serratia proteamaculans* 568 | 276 | 43% | 40% | 42% | 46% | 43% | 44% | 39% | 39% | 36% |
| gi|293395069| ref|ZP_06639356.1 | *Serratia odorifera* DSM 4582 | 394 | 44% | 40% | 44% | 45% | 44% | 46% | 41% | 40% | 35% |
| gi|156538983| ref|XP_001600823. | *Nasonia vitripennis* | 271 | 37% | 36% | 39% | 38% | 37% | 39% | 37% | 35% | 33% |
| gi|123441559| ref|YP_001005545. | *Yersinia enterocolitica* subsp. *enterocolitica* 8081 | 260 | 43% | 39% | 43% | 45% | 41% | 44% | 40% | 36% | 35% |
| gi|238799418| ref|ZP_04642848.1 | *Yersinia mollaretii* ATCC 43969 | 354 | 43% | 40% | 43% | 44% | 42% | 45% | 40% | 37% | 36% |
| gi|238764156| ref|ZP_04625109.1 | *Yersinia kristensenii* ATCC 33638 | 353 | 43% | 39% | 43% | 44% | 40% | 43% | 39% | 38% | 34% |

TABLE 4-continued

Percent Identity of KIVD cluster sequences

| KIVD cluster member | Source organism | Cluster Member SEQ ID NO: | 51 (240171442) | 52 (229556973) | 53 (228908218) | 55 (118464281) | 56 (71065418) | 58 (294497944) | 59 (291276462) | 61 (222151578) | 63 (16417060) |
|---|---|---|---|---|---|---|---|---|---|---|---|
| gi|238753136| ref|ZP_04614583.1| | Yersinia rohdei ATCC 43380 | 351 | 43% | 40% | 43% | 44% | 40% | 44% | 40% | 37% | 37% |
| gi|238759526| ref|ZP_04620689.1| | Yersinia aldovae ATCC 35236 | 352 | 43% | 39% | 43% | 44% | 41% | 44% | 40% | 37% | 35% |
| gi|189028459| sp|A0QBE6| KDC_MYC | Mycobacterium avium 104 | 299 | 83% | 37% | 40% | 99% | 47% | 42% | 41% | 36% | 35% |
| gi|118464281| ref|YP_880234.1| | Mycobacterium avium 104 | 55 | 83% | 37% | 40% | 100% | 47% | 42% | 41% | 36% | 35% |
| gi|254773861| ref|ZP_05215377.1| | Mycobacterium avium subsp. avium ATCC 25291 | 365 | 82% | 37% | 40% | 99% | 48% | 42% | 41% | 36% | 35% |
| gi|41406881| ref|NP_959717.1| | Mycobacterium avium subsp. paratuberculosis K-10 | 400 | 82% | 37% | 40% | 99% | 48% | 42% | 41% | 36% | 35% |
| gi|254818314| ref|ZP_05223315.1| | Mycobacterium intracellulare ATCC 13950 | 366 | 83% | 36% | 39% | 92% | 47% | 41% | 40% | 36% | 34% |
| gi|118616174| ref|YP_904506.1| | Mycobacterium ulcerans Agy99 | 259 | 83% | 36% | 38% | 84% | 46% | 40% | 40% | 36% | 34% |
| gi|183984651| | Mycobacterium marinum M | 294 | 83% | 36% | 38% | 84% | 46% | 40% | 40% | 36% | 34% |
| ref|YP_001852942. | | | | | | | | | | | |
| gi|5840266| ref|NP_335303.1| | Mycobacterium tuberculosis CDC1551 | 279 | 83% | 37% | 38% | 85% | 46% | 41% | 41% | 37% | 35% |
| gi|15607993| ref|NP_215368.1| | Mycobacterium tuberculosis H37Rv | 270 | 83% | 37% | 39% | 85% | 46% | 42% | 41% | 37% | 35% |
| gi|240171442| ref|ZP_04750101.1| | Mycobacterium kansasii ATCC 12478 | 51 | 100% | 35% | 37% | 83% | 46% | 40% | 39% | 36% | 34% |
| gi|15828161| ref|NP_302424.1| | Mycobacterium leprae TN | 278 | 73% | 34% | 39% | 75% | 45% | 40% | 39% | 37% | 34% |
| gi|118470767| ref|YP_889968.1| | Mycobacterium smegmatis str. MC2 155 | 258 | 73% | 35% | 40% | 75% | 45% | 44% | 41% | 37% | 36% |
| gi|237786605| ref|YP_002907310. | Corynebacterium kroppenstedtii DSM 44385 | 350 | 53% | 39% | 40% | 55% | 49% | 41% | 40% | 39% | 36% |
| gi|258654904| ref|YP_003204060. | Nakamurella multipartita DSM 44233 | 370 | 51% | 36% | 38% | 53% | 43% | 37% | 38% | 34% | 33% |

TABLE 4-continued

| KIVD cluster member | Source organism | Cluster Member SEQ ID NO: | Percent Identity of KIVD cluster sequences Identity to SEQ ID NO: (GI number) | | | | | | | | |
|---|---|---|---|---|---|---|---|---|---|---|---|
| | | | 51 (240171442) | 52 (229556973) | 53 (228908218) | 55 (118464281) | 56 (71065418) | 58 (294497944) | 59 (291276462) | 61 (222151578) | 63 (16417060) |
| gi|93005792|ref|YP_580229.1| | *Psychrobacter cryohalolentis* K5 | 416 | 46% | 39% | 39% | 46% | 93% | 40% | 38% | 37% | 35% |
| gi|71065418|ref|YP_264145.1| | *Psychrobacter arcticus* 273-4 | 56 | 46% | 39% | 39% | 47% | 100% | 41% | 39% | 37% | 35% |
| gi|148654159|ref|YP_001281252. | *Psychrobacter* sp. PRwf-1 | 265 | 47% | 39% | 39% | 48% | 74% | 41% | 39% | 38% | 35% |
| gi|227504494|ref|ZP_03934543.1 | *Corynebacterium striatum* ATCC 6940 | 320 | 49% | 37% | 38% | 48% | 46% | 40% | 38% | 36% | 35% |

Preparation of Profile HMM

The amino acid sequences of the 170 sequences described above and provided in Table Z were analyzed using the HMMER software package (The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a profile Hidden Markov Model (profile HMM) that characterizes the input sequences. As stated in the user guide, profile HMMs are statistical descriptions of the consensus of a multiple sequence alignment. They use position-specific scores for amino acids (or nucleotides) and position specific scores for opening and extending an insertion or deletion. Compared to other profile based methods, HMMs have a formal probabilistic basis. Profile HMMs for a large number of protein families are publicly available in the PFAM database (Janelia Farm Research Campus. Ashburn, Va.).

The profile HMM was built as follows:

Step 1. Build a Sequence Alignment

The 170 sequences in the cluster as described above were aligned using Clustal W (Thompson, J. D., Higgins, D. G., and Gibson T. J. (1994) Nuc. Acid Res. 22: 4673 4680) with default parameters.

Step 2. Build a Profile HMM

The hmmbuild program was run on the set of aligned sequences using default parameters. hmmbuild reads the multiple sequence alignment file, builds a new profile HMM, and saves the profile HMM to file. Using this program an uncalibrated profile was generated from the multiple sequence alignment of the 170 sequences as described in Step 1.

The following information based on the HMMER software user guide gives some description of the way that the hmmbuild program prepares a profile HMM. A profile HMM is a linear state machine consisting of a series of nodes, each of which corresponds roughly to a position (column) in the multiple sequence alignment from which it is built. If gaps are ignored, the correspondence is exact, i.e., the profile HMM has a node for each column in the alignment, and each node can exist in one state, a match state. The word "match" here implies that there is a position in the model for every position in the sequence to be aligned to the model. Gaps are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a "node".

A profile HMM has several types of probabilities associated with it. One type is the transition probability—the probability of transitioning from one state to another. There are also emissions probabilities associated with each match state, based on the probability of a given residue existing at that position in the alignment. For example, for a fairly well-conserved column in an alignment, the emissions probability for the most common amino acid may be 0.81, while for each of the other 19 amino acids it may be 0.01.

A profile HMM is completely described in a HMMER2 profile save file, which contains all the probabilities that are used to parameterize the HMM. The emission probabilities of a match state or an insert state are stored as log-odds ratio relative to a null model: $\log_2 (p\_x)/(null\_x)$. Where $p\_x$ is the probability of an amino acid residue, at a particular position in the alignment, according to the profile HMM and $null\_x$ is the probability according to the Null model. The Null model is a simple one state probabilistic model with pre-calculated set of emission probabilities for each of the 20 amino acids derived from the distribution of amino acids in the SWISSPROT release 24. State transition scores are also stored as log odds parameters and are proportional to $\log_2(t\_x)$. Where $t\_x$ is the transition probability of transiting from one state to another state.

Step 3. Calibrate the Profile HMM

The profile HMM was read using hmmcalibrate which scores a large number of synthesized random sequences with the profile (the default number of synthetic sequences used is 5,000), fits an extreme value distribution (EVD) to the histogram of those scores, and re-saves the HMM file now including the EVD parameters. These EVD parameters ($\mu$ and $\lambda$) are used to calculate the E-values of bit scores when the profile is searched against a protein sequence database. hmmcalibrate writes two parameters into the HMM file on a line labeled "EVD": these parameters are the $\mu$ (location) and $\lambda$ (scale) parameters of an extreme value distribution (EVD) that best fits a histogram of scores calculated on randomly generated sequences of about the same length and residue composition as SWISS-PROT. This calibration was done once for the profile HMM.

The calibrated profile HMM for the set of KIVD sequences is provided in Table Z and is herein referred to as the KIVD cluster profile HMM. In the main model section starting from the HMM flag line, the model has three lines per node, for M nodes (where M is the number of match states, as given by the LENG line). The first line reports the match emission log-odds scores:the log-odds ratio of emitting each amino acid from that state and from the Null model. The first number if the node number (1 . . . M). The next K numbers for match emission scores, one per amino acid. The highest scoring amino acid is indicated in the parenthesis after the node number. These log-odds scores can be converted back to HMM probabilities using the null model probability. The last number on the line represents the alignment column index for this match state. The second line reports the insert emission scores, and the third line reports on state transition scores: M→M, M→I, M→D; I→M, I→I; D→M, D→D; B→M; M→E.

Step 4. Test the Specificity and Sensitivity of the Built Profile HMMs

The Profile HMM was evaluated using hmmsearch, which reads a Profile HMM from hmmfile and searches a sequence file for significantly similar sequence matches. The sequence file searched contained 601 sequences (see above). During the search, the size of the database (Z parameter) was set to 1 billion. This size setting ensures that significant E-values against the current database will remain significant in the foreseeable future. The E-value cutoff was set at 10.

A hmmer search with the KIVD cluster profile HMM (Table Z, incorporated herein by reference) generated from the alignment of the 170 KIVD homologs, matched all 601 sequences with an E value<1E-223. This result indicates that members of the KIVD cluster share significant sequence similarity. A hmmer search with a cutoff of E value E-223 was used to separate KIVDs from other proteins. Thus, it is believed that polypeptides having a KIVD cluster profile HMM E value<1E-223 using hmmer search are suitable candidates for embodiments provided herein, such as for methods and recombinant host cells comprising the substrate to product conversion of α-ketoisovalerate to isobutyraldehyde.

It will be appreciated that, equipped with this disclosure and using a combination of structural and sequence information available in the art and provided herein, polypeptides comprising ketoisovalerate decarboxylase activity and less than 100% identity to the exemplified sequences in Tables 4, 5 and 6 may be constructed for use in host cells and methods provided herein. For example, because Applicants have demonstrated that the polypeptides provided herein have ketoisovalerate decarboxylase activity, one of skill in the art may utilize biochemical, molecular, and structural information provided herein by way of sequence information and Profile HMM as well as information available in the art regarding ketoisovalerate decarboxylases. For example, Berthold, et al., provide the structure of holo-KdcA from *L. lactis* (Acta Crys. (2007) D63: 1217-1224); Yep, et al. (Bioorganic Chemistry, 34 (2006) 325-336) developed a homology model of the structure for KdcA from *L. lactis*, identifying residues Ser286, Phe381, Val461, and Met358 as residues that appeared to shape the substrate binding pocket; Smit, et al. (Appl. Environ. Microbiol. (2005) 71:303-311) aligned the amino acid sequence of KdcA with two decarboxylating enzymes, indolepyruvate decarboxylase of *Enterobacter cloacae*, and yeast pyruvate decarboxylase, which have been studied by X-ray crystallography.

One of ordinary skill in the art, equipped with this disclosure, can also generate active fragments of polypeptides provided herein, for example, by truncating polypeptides provided herein based on sequence alignments at the N-terminus or C-terminus and confirming α-ketoisovalerate decarboxylase activity.

Accordingly, polypeptides capable of catalyzing the substrate to product conversion of α-ketoisovalerate to isobutyraldehyde disclosed herein include, but are not limited to, polypeptides comprising at least about 80%, at least about 85%, at least about 90%, at least about 95%, or at least about 99% identity to any one of SEQ ID NO: 51, 52, 53, 55, 56, 58, 59, 61, or 63 or an active fragment thereof. In embodiments, the polypeptide has a KIVD duster profile HMM E value of less than 1E-223 using the hmmsearch program. Similarly, Applicants provide herein polynucleotides encoding such polypeptides which include, but are not limited to polynucleotides comprising at least about 80%, at least about 85%, at least about 90%, at least about 95%, or at least about 99% identity to any one of SEQ ID NO: 30, 31, 32, 34, 35, 37, 38, 40, or 42, or sequences thereof which are codon-optimized for expression in a particular host cell such as, for example, *E. coli* or *S. cerevisiae*.

Thiamine diphosphate (also known as thiamine pyrophosphate or "TPP" or "TDP") is a coenzyme employed by KIVD as a cofactor. Thiamine is the vitamin form, which may be supplemented in reaction medium such as fermentation medium. Once transported into a cell, thiamine will be converted to thiamine diphosphate. In addition, certain polypeptides having ketoisovalerate decarboxylase activity disclosed herein have increased affinity for TPP as compared to the *Lactococcus lactis* polypeptide having SEQ ID NO: 68, and, as such, may provide advantages. For example, polypeptides provided herein may be useful to catalyze the substrate to product conversion of α-ketoisovalerate to isobutyraldehyde under conditions of low or diminished thiamine, potentially reducing costs and protocol complexity. In embodiments, such polypeptides comprise at least about 80%, at least about 85%, at least about 90%, at least about 95%, or at least about 99% identity to any one of SEQ ID NO: 51, 52, 53, 55, 56, 58, 59, 61, or 63 or an active fragment thereof. In some embodiments, such polypeptides comprise the sequences of kivD81, Mca, or kdcA from *Listeria grayi, Macrococcus caseolyticus*, or *Lactococcus lactis*, respectively, or an active fragment thereof. In some embodiments, such polypeptides comprise at least about 80% identity to SEQ ID NO: 52, 61, or 66 or an active fragment thereof. In some embodiments, such polypeptides comprise at least about 80% identity to SEQ ID NO: 52 or 61 or an active fragment thereof.

Polypeptides and the polynucleotides encoding them provided herein are also useful for expression in recombinant host cells, such as recombinant host cells comprising an isobutanol biosynthetic pathway which includes the substrate to product conversion of α-ketoisovalerate to isobutyraldehyde. Furthermore, Applicants have shown that polypeptides provided herein are at least as capable of converting α-ketoisovalerate to isobutyraldehyde as a *Lactococcus lactis* polypeptide sequence having SEQ ID NO: 68 in a recombinant host cell, as measured by α-ketoisovalerate accumulation during a fermentation (See Example 12). Similarly, polypeptides provided herein can provide increased isobutanol yield in recombinant host cells as compared to the isobutanol yield observed in cells employing a *Lactococcus lactis* polypeptide sequence having SEQ ID NO: 68 (See Example 12). Therefore, provided herein are recombinant host cells comprising polypeptides comprising at least about 80%, at least about 85%, at least about 90%, at least about 95%, or at least about 99% identity to any one of SEQ ID NO: 51, 52, 53, 55, 56, 58, 59, 61, or 63 or an active fragment thereof, or a polynucleotide encoding such a polypeptide.

Construction of Recombinant Host Cells

The genetic manipulations of the host cells described herein can be performed using standard genetic techniques and screening and can be made in any host cell that is suitable to genetic manipulation (*Methods in Yeast Genetics*, 2005, Cold Spring Harbor Laboratory Press, Cold Spring Harbor, NY, pp. 201-202). In embodiments, the recombinant host cells disclosed herein can be any bacteria, yeast or fungi host useful for genetic modification and recombinant gene expression. In other embodiments, a recombinant host cell can be a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula*, or *Saccharomyces*. In other embodiments, the host cell can be *Saccharomyces cerevisiae, Schizosaccharomyces pombe, Kluyveromyces lactis, Kluyveromyces thermotolerans, Kluyveromyces marxianus, Candida glabrata, Candida albicans, Pichia stipitis, Yarrowia lipolytica, E. coli*, or *L. plantarum*. In still other embodiments, the host cell is a yeast host cell. In some embodiments, the host cell is a member of the genera *Saccharomyces*. In some embodiments, the host cell is *Kluyveromyces lactis, Candida glabrata* or *Schizosaccharomyces pombe*. In some embodiments, the host cell is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Methods for gene expression in recombinant host cells, including, but not limited to, yeast cells are known in the art (see, for example, *Methods in Enzymology*, Volume 194, Guide to Yeast Genetics and Molecular and Cell Biology (Part A, 2004, Christine Guthrie and Gerald R. Fink (Eds.), Elsevier Academic Press, San Diego, Calif.). In embodiments, the coding region for the α-ketoisovalerate decarboxylase enzymes to be expressed can be codon optimized for the target host cell, as well known to one skilled in the art. Expression of genes in recombinant host cells, including but not limited to yeast cells, can require a promoter operably linked to a coding region of interest, and a transcriptional terminator. A number of promoters can be used in constructing expression cassettes for genes, including, but not limited to, the following constitutive promoters suitable for use in yeast: FBA1, TDH3 (GPD), ADH1, and GPM1; and the following inducible promoters suitable for use in yeast: GAL1, GAL10 and CUP1. Other yeast promoters include hybrid promoters UAS(PGK1)-FBA1p (SEQ ID NO: 228), UAS (PGK1)-ENO2p (SEQ ID NO: 229), UAS(FBA1)-PDC1p (SEQ ID NO: 230), UAS(PGK1)-PDC1p (SEQ ID NO: 231), and UAS(PGK)-OLE1p (SEQ ID NO: 232). Suitable transcriptional terminators that can be used in a chimeric gene construct for expression include, but are not limited to, FBA1t, TDH3t, GPM1t, ERG10t, GAL1t, CYC1t, and ADH1t.

Vectors useful for the transformation of a variety of host cells are common and described in the literature. Typically the vector contains a selectable marker and sequences allowing autonomous replication or chromosomal integration in the desired host. In addition, suitable vectors can comprise a promoter region which harbors transcriptional initiation controls and a transcriptional termination control region, between which a coding region DNA fragment may be inserted, to provide expression of the inserted coding region. Both control regions can be derived from genes homologous to the transformed host cell, although it is to be understood that such control regions can also be derived from genes that are not native to the specific species chosen as a production host.

In embodiments, suitable promoters, transcriptional terminators, and α-ketoisovalerate decarboxylase coding regions can be cloned into E. coli-yeast shuttle vectors, and transformed into yeast cells. Such vectors allow strain propagation in both E. coli and yeast strains, and can contain a selectable marker and sequences allowing autonomous replication or chromosomal integration in the desired host. Typically used plasmids in yeast include, but are not limited to, shuttle vectors pRS423, pRS424, pRS425, and pRS426 (American Type Culture Collection, Rockville, Md.), which contain an E. coli replication origin (e.g., pMB1), a yeast 2-micron origin of replication, and a marker for nutritional selection. The selection markers for these four vectors are HIS3 (vector pRS423), TRP1 (vector pRS424), LEU2 (vector pRS425) and URA3 (vector pRS426).

In embodiments, construction of expression vectors with a chimeric gene encoding the described enzymes can be performed by the gap repair recombination method in yeast. In embodiments, a yeast vector DNA is digested (e.g., in its multiple cloning site) to create a "gap" in its sequence. A number of insert DNAs of interest are generated that contain an approximately 21 bp sequence at both the 5' and the 3' ends that sequentially overlap with each other, and with the 5' and 3' terminus of the vector DNA. For example, to construct a yeast expression vector for "Gene X," a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an E. coli strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. In embodiments, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding region X-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

KIVD Activity

The presence of α-ketoisovalerate decarboxylase activity in the recombinant host cells disclosed herein can be confirmed using routine methods known in the art. In a non-limiting example, and as described in the Examples herein, transformants can be screened by PCR using primers for α-ketoisovalerate decarboxylase genes. In another non-limiting example, and as described in the examples herein, α-ketoisovalerate decarboxylase activity can be assayed by expressing α-ketoisovalerate decarboxylase enzymes disclosed herein in a recombinant host cell disclosed herein that lacks endogenous α-ketoisovalerate decarboxylase activity. In another non-limiting example, α-ketoisovalerate decarboxylase activity can be confirmed by more indirect methods, such as by measuring the products downstream from isobutyraldehyde in a biosynthetic pathway. In another non-limiting example, α-ketoisovalerate decarboxylase activity can be confirmed by measuring cofactor disappearance, or by measuring cofactor disappearance for a step downstream from isobutyraldehyde in a biosynthetic pathway, for example, a coupled assay as described herein and/or in the art (see, for example, Zhang et al., PNAS (2008) 105(52): 20653-20658). In another non-limiting example, α-ketoisovalerate decarboxylase activity can be confirmed by determining the rates for the conversion of α-ketoisovalerate to isobutryaldehyde with the aldehyde-specific Purpald® colorimetric enzyme assay, described herein. In another non-limiting example, α-ketoisovalerate decarboxylase activity can be confirmed by measuring disappearance of α-ketoisovalerate using methods known in the art (see, for example, de la Plaza, et al. FEMS Microbiol Letters (2004) 238:367-374).

The TPP cofactor activation constant, which provides a measure of the enzyme affinity for TPP is described in Chang et al. (Biochem. J. (1999) 339: 255-260). The TPP cofactor activation constant of polypeptides provided herein can be determined by plotting the specific activities observed as a function of TPP concentration. The rates for the conversion of α-ketoisovalerate to isobutyraldehyde may be measured in a horse liver ADH (hADH) coupled enzyme assay, which has been described in Gocke, D. et al. (Adv. Synth. Catal. 2007, 349, 1425-1435), run at different TPP concentrations. Specific activities are then plotted against TPP concentration. Resulting curves may then be fit to the saturation equation $SA=(SA_{max}*[TPP])/(K_c+[TPP])+C$, where SA is the specific activity, $SA_{max}$ is maximum specific activity, $K_c$ is the cofactor activation constant, [TPP] is the concentration of TPP, and C is the activity in the absence of added TPP, using software such as Kaleidagraph (Synergy) to determine the cofactor activation constant ($K_c$). The TPP affinity of polypeptides can also be measured via fluorescence quenching as described in Chang et al. (Biochem. J. (1999) 339:255-260).

In embodiments, polypeptides provided herein have a TPP cofactor activation constant ($K_c$) less than about 5 μM, less than about 10 μM, less than about 20 μM, less than about 30 μM, less than about 40 μM, less than about 50 μM, less than about 70 μM, or less than about 90 μM.

The substrate specificity ratio provides a measure of the ability of an enzyme to discriminate between the reactions of competing substrates and is described by Fersht, A. (Enzyme Structure and Mechanism, 1977, 1985 W.H. Freeman and Company, New York). The α-ketoisovalerate to pyruvate specificity ratio for a given polypeptide can be determined by measuring the $V_{max}$ and $K_M$ values for the conversion of α-ketoisovalerate to isobutyraldehyde and the $V_{max}$ and $K_M$ values for the conversion of pyruvate to acetaldehyde. The rates for the conversion of α-ketoisovalerate to isobutyraldehyde and for pyruvate to acetaldehyde may be measured in a horse liver ADH (hADH) coupled enzyme assay which has been described in Gocke, D. et al. (Adv. Synth. Catal. 2007, 349, 1425-1435) run at different substrate concentration. Specific activities are then plotted against substrate concentration. Resulting curves may then be fit to the Michaelis-Menton using software such as Kaleidagraph (Synergy) to determine $V_{max}$ and $K_M$ values for each substrate. "Specificity ratio" as used herein is the quotient of $V_{max}/K_M$ determined for α-ketoisovalerate divided by the $V_{max}/K_M$ determined for pyruvate.

In embodiments, the specificity ratio for polypeptides disclosed herein is greater than about 1, greater than about 10, greater than about 20, greater than about 50, greater than about 100, greater than about 150, greater than about 200, greater than about 250, or greater than about 300.

Provided herein are methods of converting α-ketoisovalerate to isobutyraldehyde employing the polypeptides disclosed. In embodiments, methods comprise: (a) providing a polypeptide wherein said polypeptide comprises at least one of: (i) at least 80%, at least 90%, at least 95%, or at least 99% identity to SEQ ID NO: 51, 52, 53, 55, 56, 58, 59, 61 or 63 or an active fragment thereof and α-ketoacid decarboxylase activity; or (ii) α-ketoacid decarboxylase activity, a specificity ratio for α-ketoisovalerate to pyruvate greater than about 1, greater than about 10, greater than about 100, greater than about 150, or greater than about 200, and thiamine diphosphate cofactor activation constant ($K_c$) of about 100 μM, about 50 μM, or about 20 μM or less; and (b) contacting said polypeptide with α-ketoisovalerate under conditions wherein isobutyraldehyde is produced. In embodiments, methods comprise: (a) providing a polypeptide wherein said polypeptide comprises at least 80%, at least 90%, at least 95%, or at least 99% identity to SEQ ID NO: 51, 52, 53, 55, 56, 58, 59, 61 or 63 or an active fragment thereof and α-ketoacid decarboxylase activity; and (b) contacting said polypeptide with α-ketoisovalerate under conditions wherein isobutyraldehyde is produced. In embodiments, said polypeptide comprises at least 80%, at least 90%, at least 95%, or at least 99% identity to SEQ ID NO: 52 or 61 or an active fragment thereof. In embodiments, methods comprise: (a) providing a polypeptide wherein said polypeptide comprises α-ketoacid decarboxylase activity, a specificity ratio for α-ketoisovalerate to pyruvate greater than about 1, greater than about 10, greater than about 100, greater than about 150, or greater than about 200, and thiamine diphosphate cofactor activation constant ($K_c$) of about 100 μM, about 50 μM, or about 20 μM or less; and (b) contacting said polypeptide with α-ketoisovalerate under conditions wherein isobutyraldehyde is produced. In embodiments, the contacting occurs in the presence of less than about 10 mg/L thiamine. In embodiments, the contacting occurs in the presence of less than about 30 mg/L thiamine, less than about 20 mg/L thiamine, or less than about 5 mg/L thiamine. In embodiments, the contacting occurs in the presence of about 1 to about 10 mg/L thiamine, about 5 to about 20 mg/L thiamine, about 10 to about 15 mg/L thiamine, about 5 to about 15 mg/L thiamine, about 5 to about 10 mg/L thiamine, or about 1 to about 5 mg/L thiamine. In embodiments, the contacting occurs within a recombinant host cell and wherein the polypeptide is heterologous to recombinant host cell. In embodiments, the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula*, or *Saccharomyces*. In embodiments, the recombinant host cell is *Saccharomyces cerevisiae*. In embodiments, the recombinant host cell further comprises heterologous polynucleotides encoding polypeptides which catalyze the substrate to product conversions: (a) pyruvate to acetolactate; (b) acetolactate to 2,3-dihydroxyisovalerate; and (c) 2,3-dihydroxyisovalerate to 2-ketoisovalerate. In embodiments, the host cell further comprises a heterologous polynucleotide encoding a polypeptide which catalyzes the substrate to product conversion isobutyraldehyde to isobutanol. In embodiments, the recombinant host cell further comprises reduced or eliminated pyruvate decarboxylase activity. In embodiments, the recombinant host cell further comprises at least one deletion, mutation, and/or substitution in an endogenous gene encoding a polypeptide affecting Fe—S cluster biosynthesis. In embodiments, the recombinant host cell comprises deletion of fra2. In embodiments, the recombinant host cell comprises reduced or eliminated glycerol-3-phosphate dehydrogenase activity.

Production of Isobutanol

Provided herein are methods of producing isobutanol. In embodiments, the methods comprise: (a) providing a host cell comprising an isobutanol biosynthetic pathway and a polypeptide wherein said polypeptide comprises at least one of: i) at least 80%, at least 90%, at least 95%, or at least 99% identity to SEQ ID NO: 51, 52, 53, 55, 56, 58, 59, 61, or 63 or an active fragment thereof and α-ketoacid decarboxylase activity or (ii) α-ketoacid decarboxylase activity, a specificity ratio for α-ketoisovalerate to pyruvate greater than about 1, greater than about 10, greater than about 100, greater than about 150, or greater than about 200, and thiamine diphosphate cofactor activation constant ($K_c$) of about 100 μM, about 50 μM, or about 20 μM or less; and (b) contacting the host cell with a fermentable carbon substrate under conditions whereby isobutanol is produced. In embodiments, the contacting occurs in the presence of less than about 10 mg/L thiamine or less than about 1 mg/L thiamine. In embodiments, the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula*, or *Saccharomyces*. In embodiments, the recombinant host cell is *Saccharomyces cerevisiae*. In embodiments, the recombinant host cell further comprises heterologous polynucleotides encoding polypeptides which catalyze the substrate to product conversions: (a) pyruvate to acetolactate; (b) acetolactate to 2,3-dihydroxyisovalerate; and (c) 2,3-dihydroxyisovalerate to 2-ketoisovalerate. In embodiments, the host cell further comprises a heterologous polynucleotide encoding a polypeptide which catalyzes the substrate to product conversion isobutyraldehyde to isobutanol. In embodiments, the recombinant host cell further comprises reduced or eliminated pyruvate decarboxylase activity. In embodiments, the recombinant host cell further comprises at least one deletion, mutation, and/or substitution in an endogenous gene encoding a polypeptide affecting Fe—S cluster biosynthesis. In embodiments, the recombinant host cell further comprises deletion of fra2. In embodiments, the recombinant host cell comprises reduced or eliminated glycerol-3-phosphate dehydrogenase activity. In embodiments isobutanol is produced at an effective yield greater than that produced by the analogous host cell comprising a heterologous polynucleotide encoding a polypeptide comprising SEQ ID NO: 68 and not (i) or (ii).

Accordingly, also provided herein are recombinant host cells comprising (i) a heterologous polypeptide which catalyzes the substrate to product conversion of α-ketoisovalerate to isobutyraldehyde wherein said polypeptide comprises at least about 80% identity to SEQ ID NO: 51, 52, 53, 55, 56, 58, 59, 61 or 63 or an active fragment thereof; or a heterologous polynucleotide encoding a heterologous polypeptide of (i). In embodiments, said polypeptide comprises at least about 95% identity to SEQ ID NO: 51, 52, 53, 55, 56, 58, 59, 61 or 63 or an active fragment thereof. In embodiments, host cells further comprise heterologous polynucleotides encoding polypeptides which catalyze the substrate to product conversions: (a) pyruvate to acetolactate; (b) acetolactate to 2,3-dihydroxyisovalerate; (c) 2,3-dihydroxyisovalerate to 2-ketoisovalerate. In embodiments, host cells further comprising a heterologous polynucleotide encoding a polypeptide which catalyzes the substrate to product conversion isobutyraldehyde to isobutanol. In embodiments, each of the polypeptides which catalyze the substrate to product conversions are non-native to the host cell. In embodiments, the recombinant host cell comprises reduced or eliminated pyruvate decarboxylase activity. In embodiments, the recombinant host cell comprises at least one deletion, mutation, and/or substitution in an endogenous gene encoding a polypeptide affecting Fe—S cluster biosynthesis. In embodiments, the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula*, or *Saccharomyces*. In embodiments, the recombinant host cell is *Saccharomyces cerevisiae*.

Isobutanol Biosynthetic Pathway

Biosynthetic pathways for the production of isobutanol that may be used include those described in U.S. Pat. Nos. 7,851,188, 7,889,993, and 8,178,328, all incorporated herein by reference. One isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by acetohydroxy acid reductoisomerase;

2,3-dihydroxyisovalerate to α-ketoisovalerate, which may be catalyzed, for example, by acetohydroxy acid dehydratase;

α-ketoisovalerate to isobutyraldehyde, which may be catalyzed, for example, by a branched-chain keto acid decarboxylase; and isobutyraldehyde to isobutanol, which may be catalyzed, for example, by a branched-chain alcohol dehydrogenase.

In some embodiments, the isobutanol biosynthetic pathway comprises at least one polynucleotide, at least two polynucleotides, at least three polynucleotides, or at least four polynucleotides that is/are heterologous to the host cell. In embodiments, each substrate to product conversion of an isobutanol biosynthetic pathway in a recombinant host cell is catalyzed by a heterologous polypeptide. In embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing NADH as a cofactor.

Genes and polypeptides that can be used for substrate to product conversions described herein as well as methods of identifying such genes and polypeptides, are described herein and/or in the art, for example, for isobutanol, in the Examples and in U.S. Pat. Nos. 7,851,188, 7,889,993, and 8,178,328. Example ketol-acid reductoisomerase (KARI) enzymes are described in U.S. Pat. Nos. 8,129,162 and 8,222,017 and in U.S. Patent Appl. Pub. Nos. 20080261230 A1, 20100197519 A1, and PCT Appl. Pub. No. WO/2011/041415, all of which are incorporated by reference. Examples of KARIs disclosed therein are those from *Lactococcus lactis, Vibrio cholera, Pseudomonas aeruginosa* PAO1, and *Pseudomonas fluorescens* PF5 variants. KARIs include *Anaerostipes caccae* KARI variants "K9G9" and "K9D3" (SEQ ID NOs: 235 and 234, respectively). US Appl. Pub. No. 20100081154 A1, and U.S. Pat. No. 7,851,188 describe dihydroxyacid dehydratases (DHADs), including a DHAD from *Streptococcus mutans* (protein SEQ ID NO: 417). U.S. Pat. No. 8,188,250, incorporated herein by reference, describes SadB, an alcohol dehydrogenase (ADH) from *Achromobacter xylosoxidans*. Alcohol dehydrogenases also include horse liver ADH ("HADH") and *Beijerinkia indica* ADH (protein SEQ ID NO: 247) described in US Appl. Pub. No. 20110269199, incorporated herein by reference.

It will be appreciated that host cells comprising an isobutanol biosynthetic pathway as provided herein may further comprise one or more additional modifications. U.S. Appl. Pub. No. 20090305363 (incorporated by reference) discloses increased conversion of pyruvate to acetolactate by engineering yeast for expression of a cytosol-localized acetolactate synthase and substantial elimination of pyruvate decarboxylase activity. Modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 20090305363 (incorporated herein by reference), modifications to a host cell that provide for increased carbon flux through an Entner-Doudoroff Pathway or reducing equivalents balance as described in U.S. Patent Appl. Pub. No. 20100120105 (incorporated herein by reference). Other modifications include integration of at least one polynucleotide encoding a polypeptide that catalyzes a step in a pyruvate-utilizing biosynthetic pathway. Other modifications include at least one deletion, mutation, and/or substitution in an endogenous polynucleotide encoding a polypeptide having acetolactate reductase activity. In embodiments, the polypeptide having acetolactate reductase activity is YMR226C (SEQ ID NO: 236) of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity. In embodiments, the polypeptide having aldehyde dehydrogenase activity is ALD6 (SEQ ID NO: 233) from *Saccharomyces cerevisiae* or a homolog thereof. A genetic modification which has the effect of reducing glucose repression wherein the yeast production host cell is pdc- is described in U.S. Appl. Publication No. 20110124060, incorporated herein by reference.

Recombinant host cells may further comprise (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT1 (nucleic acid SEQ ID NO: 237, amino acid SEQ ID NO: 238), AFT2 (SEQ ID NOs: 239 and 240), FRA2 (SEQ ID NOs: 241 and 242), GRX3 (SEQ ID NOs: 243 and 244), or CCC1 (SEQ ID NOs: 245 and 246). In embodiments, the polypeptide affecting Fe—S cluster biosynthesis is constitutive mutant AFT1 L99A, AFT1 L102A, AFT1 C291F, or AFT1 C293F.

Growth for Production

Recombinant host cells disclosed herein are grown in fermentation media which contains suitable carbon substrates. Additional carbon substrates may include, but are not limited to, monosaccharides such as fructose, oligosaccharides such as lactose, maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

Additionally the carbon substrate may also be one-carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., Microb. Growth C1 Compd., [Int. Symp.], 7th (1993), 415-32, Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and/or arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Patent Application Publication No. 20070031918 A1. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, rapeseed, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers (e.g., sunflowers and safflower), animal manure, and mixtures thereof.

In addition to an appropriate carbon source, fermentation media must contain suitable minerals, salts, cofactors, buffers and other components, known to those skilled in the art, suitable for the growth of the cultures and promotion of an enzymatic pathway described herein.

Culture Conditions

Typically cells are grown at a temperature in the range of about 20° C. to about 40° C. in an appropriate medium. Suitable growth media in the present invention include common commercially prepared media such as Luria Bertani (LB) broth, Sabouraud Dextrose (SD) broth, Yeast Medium (YM) broth, or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2':3'-monophosphate, may also be incorporated into the fermentation medium.

Suitable pH ranges for the fermentation are between about pH 5.0 to about pH 9.0. In one embodiment, about pH 6.0 to about pH 8.0 is used for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are between about pH 3.0 to about pH 7.5. In one embodiment, about pH 4.5 to about pH 6.5 is used for the initial condition.

Fermentations may be performed under aerobic or anaerobic conditions. In one embodiment, anaerobic or microaerobic conditions are used for fermentations.

Industrial Batch and Continuous Fermentations

Isobutanol, or other products, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992).

Isobutanol, or other products, may also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, may be practiced using batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because isobutanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol can also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption can also be used to isolate isobutanol from the fermentation medium. In this method, the fermentation broth containing the isobutanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, an ester can be formed by contacting the alcohol in a fermentation medium with an organic acid (e.g., fatty acids) and a catalyst capable of esterifying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

Isobutanol titer in any phase can be determined by methods known in the art, such as via high performance liquid chromatography (HPLC) or gas chromatography, as described, for example in US20090305370, incorporated herein by reference.

EXAMPLES

Plasmids pYZ090 (SEQ ID NO: 69) was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

pYZ090 was digested with SpeI and NotI to remove most of the CUP1 promoter and all of the alsS coding sequence and CYC terminator. The vector was then self-ligated after treatment with Klenow fragment and transformed into *E. coli* StbI3 cells, selecting for ampicillin resistance. Removal of the DNA region was confirmed for two independent clones by DNA sequencing across the ligation junction by PCR. The resulting plasmid was named pYZ090ΔalsS (SEQ ID NO: 182).

Plasmid pLH702 (SEQ ID NO: 218) was constructed in a series of steps from pYZ090 as described in the following paragraphs. This plasmid expresses KARI variant K9D3 (SEQ ID NO: 234) from the yeast ILV5 promoter.

pYZ058 (pHR81-PCUP1-AlsS-PILV5-yeast KARI) was derived from pYZ090 (pHR81-PCUP1-AlsS-PILV5-*lactis* KARI). pYZ090 was cut with PmeI and SfiI enzymes, and ligated with a PCR product of yeast KARI. The PCR product was amplified from genomic DNA of *Saccharomyces cerevisiae* BY4741 (Research Genetics Inc.) strain using upper primer 5'-catcatcacagtttaaacagtatgttgaagcaaatcaacttcggtgg-3' (SEQ ID NO: 248) and lower primer 5'-ggacgggccctgcaggccttattggttttctggtctcaactttctgac-3' (SEQ ID NO: 249), and digested with PmeI and SfiI enzymes. pYZ058 was confirmed by sequencing. pLH550 (pHR81-PCUP1-AlsS-PILV5-Pf5.KARI) was derived from pYZ058. The wild type Pf5.KARI gene was PCR amplified with OT1349 (5'-catcatcacagtttaaacagtatgaaagttttctacgataaagactgcgacc-3' (SEQ ID NO: 250)) and OT1318 (5'-gcacttgataggcctgcagggccttagttcttggctttgtcgacgattttg-3' (SEQ ID NO: 251)), digested with PmeI and SfiI enzymes and ligated with pYZ058 vector cut with PmeI and SfiI. The vector generated, pLH550, was confirmed by sequencing. pLH556 was derived from pLH550 by digesting the vector with SpeI and NotI enzymes, and ligating with a linker annealed from OT1383 (5'-ctagtcaccggtggc-3' (SEQ ID NO: 252)) and OT1384 (5'-ggccgccaccggtga-3' (SEQ ID NO: 253)) which contains overhang sequences for SpeI and NotI sites. This cloning step eliminates the alsS gene and a large fragment of the PCUP1 promoter from the plasmid, with 160 bp residual upstream sequence that is not functional. pLH556 was confirmed by sequencing. pLH702 was derived from pLH556. The K9D3 mutant KARI gene was excised from another vector using PmeI and SfiI enzymes, and ligated with pLH556 at PmeI and SfiI sites, replacing the Pf5.KARI gene with the K9D3 gene. The constructed vector pLH702 was confirmed by sequencing.

The pLH468 plasmid was constructed for expression of DHAD, KivD and HADH in yeast. pBP915 was constructed from pLH468 by deleting the kivD gene and 957 base pairs of the TDH3 promoter upstream of kivD. pLH468 was digested with SwaI and the large fragment (12896 bp) was purified on an agarose gel followed by a Gel Extraction kit (Qiagen; Valencia, Calif.). The isolated fragment of DNA was self-ligated with T4 DNA ligase and used to transform electro-competent TOP10 Escherichia coli (Invitrogen; Carlsbad, Calif.). Plasmids from transformants were isolated and checked for the proper deletion by restriction analysis with the SwaI restriction enzyme. Isolates were also sequenced across the deletion site. A clone with the proper deletion was designated pBP915 (pLH468ΔkivD; SEQ ID NO: 166).

pYZ067 (SEQ ID NO: 254) was constructed to contain the following chimeric genes: 1) the coding region of the ilvD gene from S. mutans UA159 with a C-terminal Lumio tag expressed from the yeast FBA1 promoter followed by the FBA1 terminator for expression of dihydroxy acid dehydratase, 2) the coding region for horse liver ADH expressed from the yeast GPM1 promoter followed by the ADH1 terminator for expression of alcohol dehydrogenase, and 3) the coding region of the KivD gene from Lactococcus lactis expressed from the yeast TDH3 promoter followed by the TDH3 terminator for expression of ketoisovalerate decarboxylase.

Plasmid pYZ067ΔkivDΔhADH was constructed from pYZ067 by deleting the promoter-gene-terminator cassettes for both kivD and adh. pYZ067 was digested with BamHI and SacI (New England BioLabs; Ipswich, Mass.) and the 7934 bp fragment was purified on an agarose gel followed by a Gel Extraction kit (Qiagen; Valencia, Calif.). The isolated fragment of DNA was treated with DNA Polymerase I, Large (Klenow) Fragment (New England BioLabs; Ipswich, Mass.) and then self-ligated with T4 DNA ligase and used to transform competent TOP10 Escherichia coli (Invitrogen; Carlsbad, Calif.). Plasmids from transformants were isolated and checked for the proper deletion by sequence analysis. A correct plasmid isolate was designated pYZ067ΔkivDΔhADH (SEQ ID NO: 255).

Example 1

Expression of Candidate Enzymes in E. coli

Based on a biodiversity search (described herein above), genes encoding 9 enzymes (Table 5) were synthesized using codons optimized for expression in E. coli (DNA2.0, Menlo Park, Calif.). Each gene was cloned under control of the T5 promoter in the vector pJexpress404 (DNA2.0, Menlo Park, Calif.) and expressed in E. coli Top10 (Invitrogen, San Diego, Calif.). Following shake flask growth at 37 C to OD600 nm=0.5 in LB media supplemented with 100 ug ampicillin/mL, with or without supplementation of 30 mg/L thiamine, 1 mM IPTG was added and the cultures grown for an additional 14-16 hrs. Cells were harvested by centrifugation and heterologous protein expression was confirmed by SDS-PAGE.

TABLE 5

Candidate KIVD enzymes.

| ID | Organism source | GI ref | | SEQ ID NO |
|---|---|---|---|---|
| kivD75 | Erwinia amylovora | 292488940 | optimized NT | 2 |
| | | | native NT | 25 |
| | | | AA | 46 |
| kivD76 | Thauera sp. MZ1T | 217968563 | optimized NT | 3 |
| | | | native NT | 26 |
| | | | AA | 47 |
| kivD77 | Frankia sp. Eul1c | 280960373 | optimized NT | 4 |
| | | | native NT | 27 |
| | | | AA | 48 |
| kivD78 | Acinetobacter sp. RUH2624 | 260549701 | optimized NT | 5 |
| | | | native NT | 28 |
| | | | AA | 49 |
| kivD79 | Anabaena variabilis ATCC 29413 | 75910313 | optimized NT | 6 |
| | | | native NT | 29 |
| | | | AA | 50 |
| kivD80 | Mycobacterium kansasii ATCC 12478 | 240171442 | optimized NT | 7 |
| | | | native NT | 30 |
| | | | AA | 51 |
| kivD81 | Listeria grayi DSM 20601 | 229556973 | optimized NT | 8 |
| | | | native NT | 31 |
| | | | AA | 52 |
| kivD82 | Bacillus thuringiensis IBL 200 | 228908218 | optimized NT | 9 |
| | | | native NT | 32 |
| | | | AA | 53 |
| kivD83 | Staphylococcus epidermidis M23864:W1 | 242372336 | optimized NT | 10 |
| | | | native NT | 33 |
| | | | AA | 54 |

Example 2

Expression of Candidate Enzymes in E. coli

Based on the enzyme assay results from the first round biodiversity search, genes encoding 13 additional enzymes (Table 6) were synthesized using codons optimized for expression in E. coli (DNA2.0, Menlo Park, Calif.). In addition, a codon optimized gene encoding the L. lactis kivD (control; SEQ ID NO:1) was prepared. Each gene was cloned under control of the T5 promoter in the vector pJexpress404 (DNA2.0, Menlo Park, Calif.) and expressed in E. coli Top10 (Invitrogen, San Diego, Calif.). Following shake flask growth at 37 C to OD600 nm=0.5 in LB media supplemented with 100 ug ampicillin/mL, with or without supplementation of 30 mg/L thiamine, 1 mM IPTG was added and the cultures grown for an additional 14-16 hrs. Cells were harvested by centrifugation and heterologous protein expression was confirmed by SDS-PAGE.

TABLE 6

Second round selection of candidate KIVD enzymes.

| ID | Organism source | GI ref | | SEQ ID NO |
|---|---|---|---|---|
| Mav | Mycobacterium avium 104 | 118464281 | optimized NT | 11 |
| | | | native NT | 34 |
| | | | AA | 55 |

TABLE 6-continued

Second round selection of candidate KIVD enzymes.

| ID | Organism source | GI ref | | SEQ ID NO |
|---|---|---|---|---|
| Par | Psychrobacter arcticus 273-4 | 71065418 | optimized NT | 12 |
| | | | native NT | 35 |
| | | | AA | 56 |
| Cst | Corynebacterium striatum ATCC 6940 | 227506048 | optimized NT | 13 |
| | | | native NT | 36 |
| | | | AA | 57 |
| Bme | Bacillus megaterium QM B1551 | 294497944 | optimized NT | 14 |
| | | | native NT | 37 |
| | | | AA | 58 |
| Hmu | Helicobacter mustelae 12198 | 291276462 | optimized NT | 15 |
| | | | native NT | 38 |
| | | | AA | 59 |
| Cac | Clostridium acetobutylicum ATCC 824 | 15004729 | optimized NT | 16 |
| | | | native NT | 39 |
| | | | AA | 60 |
| Mca | Macrococcus caseolyticus JCSC5402 | 222151578 | optimized NT | 17 |
| | | | native NT | 40 |
| | | | AA | 61 |
| Npu | Nostoc punctiforme PCC 73102 | 186682481 | optimized NT | 18 |
| | | | native NT | 41 |
| | | | AA | 62 |
| Sve | Sarcina ventriculi | 16417060 | optimized NT | 19 |
| | | | native NT | 42 |
| | | | AA | 63 |
| Bth | Bacillus thuringiensis serovar tochigiensis BGSC 4Y1 | 228985570 | optimized NT | 20 |
| | | | native NT | 43 |
| | | | AA | 64 |
| Bce | Bacillus cereus Rock3-29 | 229100258 | optimized NT | 21 |
| | | | native NT | 44 |
| | | | AA | 65 |
| kdcA | Lactococcus lactis | 44921617 | optimized NT | 22 |
| | | | native NT | 45 |
| | | | AA | 66 |
| kdcA_F381W | Lactococcus lactis | | optimized NT | 23 |
| | | | AA | 67 |
| kivD | Lactococcus lactis (control) | 51870502 | optimized NT | 1 |
| | | | native NT | 24 |
| | | | AA | 68 |

Example 3

Identification of Enzymes that Exhibit KIVD Activity when Expressed in E. coli Putative KIVD enzymes were identified as having the desired α-ketoisovalerate (αKIV) decarboxylase activity by enzymatic assay of E. coli cell free extracts, described below. The expression of the putative enzymes in E. coli is detailed in Examples 1 and 2.

Preparation of Cell Free Extract

E. coli cells were suspended in 3 mL of 100 mM HEPES, pH 6.8, 10 mM MgCl₂ and broken by sonication at 0° C. The cells were sonicated with a microtip probe for 10 seconds, with 25 seconds of rest. This cycle was repeated 12 times, for a total of 2 minutes of sonication. The crude extract from the broken cells was centrifuged to pellet the cell debris. The supernatants were removed and stored on ice until assayed.

Protein Quantification

The total protein concentration in cell free extracts was measured by the Bradford Assay using Coomassie Plus (Thermo Scientific #23238, Rockford, Ill.). BSA was employed as a standard. The concentration of protein was measured by following absorbance at 595 nm using a Cary 300 spectrophotometer (Agilent Technologies, Wilmington Del.).

KIVD Enzyme Assay Protocol—Coupled

The rates for the conversion of α-ketoisovalerate to isobutyraldehyde were measured in a horse liver ADH (hADH) coupled enzyme assay, which has been described in Gocke, D. et al. (Adv. Synth. Catal. 2007, 349, 1425-1435). Assays of cell free extracts were performed at 30° C. in buffer containing 100 mM HEPES pH 6.8, 10 mM MgCl₂, 200 µM NADH, 500 µM TPP, 30 mM α-KIV (Sigma), and 0.45 U hADH (1 mg=1.5 U) (Sigma). The oxidation of NADH was monitored at 340 nm in a 1 cm path length cuvette on a Cary 300 spectrophotometer (Agilent Technologies, Wilmington Del.) The enzyme rate was calculated using the molar extinction coefficient of $6220\ M^{-1}\ cm^{-1}$ for NADH. Controls at various concentrations of hADH and cell free extract ensured that measured rate was determined by KIVD enzyme activity.

The specific activities of the putative KIVD enzymes expressed in E. coli were calculated from measured enzyme activities and total protein concentrations. The results from round 1 and 2 are shown in Tables 7 and 8, respectively.

TABLE 7

KIVD activities for Round 1 Putatives

| ID | Specific Activity (U/mg) |
|---|---|
| kivD75 | 0.1 |
| kivD76 | <0.1 |
| kivD77 | <0.1 |
| kivD78 | 0.14 |
| kivD79 | <0.1 |
| kivD80 | 4.0 |
| kivD81 | 16.5 |
| kivD82 | 1.6 |
| kivD83 | 0.07 |

TABLE 8

KIVD activities for Round 2 Putatives

| ID | Specific Activity (U/mg) |
|---|---|
| Mav | 1.2 |
| Par | 2.7 |
| Cst | <0.1 |
| Bme | <0.1 |
| Hmu | <0.1 |
| Cac | 0.4 |
| Mca | 13.9 |
| Npu | <0.1 |
| Sve | 0.23 |
| Bth | 1.9 |
| Bce | <0.1 |
| kdcA | 11.8 |
| kivD | 59.5 |
| Vector control | <0.1 |

KIVD Enzyme Assay Protocol—Colorimetric

The rates for the conversion of α-ketoisovalerate to isobutryaldehyde for three enzymes with high KIVD activities were also measured with the aldehyde-specific Purpald® (Sigma) colorimetric enzyme assay, which has been described by DuPont-Durst and Gokel (J. Chem Edu. 1978, 55, 206). Assays of cell free extracts were performed at 30° C. in buffer containing 100 mM HEPES pH 6.8, 10 mM $MgCl_2$, 500 µM TPP and 30 mM α-KIV. The total reaction volume was 1 mL. Formation of isobutyraldehyde was monitored by removing 200 µL aliquots at fixed time points (0, 10, 20 and 30 minutes) and quenching the reaction in 1 mL of Purpald® stock solution (5 mg/mL of Purpald in 2 M NaOH). The mixture was then incubated at room temperature for 20 minutes to allow for color development. The mixture was mixed every 5 minutes during the incubation process. A standard curve of 0 to 10 mM isobutyraldehyde was used to determine the concentration of isobutyraldehyde being generated by the enzyme. 200 µL of each standard was made and added to 1 mL Purpald® stock solution alongside the zero time point. The standard was incubated at room temperature for 20 minutes and mixed every 5 minutes. Absorbance at 535 nm was measured with a Cary 300 spectrophotometer (Agilent Technologies, Wilmington Del.). The specific activities of the putative KIVD enzymes expressed in E. coli were calculated from measured enzyme activities and total protein concentrations.

Equivalent specific activities were found with the colorimetric and continuous coupled assays as shown in Table 9.

TABLE 9

Comparison of Colorimetric and Coupled Assays

| ID | SA, U/mg (Colorimetric) | SA, U/mg (Coupled) |
|---|---|---|
| KivD (L. lactis) | 27.0 | 29.0 |
| KivD81 | 5.9 | 6.3 |
| Mca | 14.9 | 17 |

Example 4

Measurement of TPP Cofactor Activation Constant of KIVD to Enzymes

The three putative KIVD enzymes with the highest activity from Rounds 1 and 2 (KivD80, KivD81, and Mca), L. lactis KivD and KdcA were evaluated for TPP cofactor activation constants in crude lysates of the E. coli cells. The expression of these enzymes in E. coli is described in Examples 1 and 2. Generation of crude lysates and protein quantification were performed as described in Example 3.

Desalting of Cell Free Extract

Zeba Desalt Spin Columns (VWR PI89889) were used to desalt the protein to remove loosely associated TPP. Column preparation was performed according to the manufacturer's instructions. All centrifugation steps were conducted at 1000×g for 2 minutes. The first centrifugation step removed the manufacturer's storage buffer. Four wash steps, consisting of the addition of 2 mL 100 mM HEPES, pH 6.8 to the column and followed by centrifugation, prepared the column for desalting the cell lysate. After the wash steps were finished, the column was placed in a fresh 15 mL Corning tube (VWR, 21008-670) and 600 µL of the cell lysate was added to the desalting column and centrifuged. The effluent was collected and analyzed for TPP dependent KivD activity.

KIVD Enzyme Assay Protocol—Coupled

The rates for the conversion of α-ketoisovalerate to isobutryaldehyde were measured in a horse liver ADH (hADH) coupled enzyme assay, which has been described in Gocke, D. et al. (Adv. Synth. Catal. 2007, 349, 1425-1435). Assays of cell free extracts were performed at 30° C. in buffer containing 100 mM HEPES pH 6.8, 10 mM $MgCl_2$, 200 µM NADH, 30 mM α-KIV (Sigma), and 0.45 U hADH (1 mg=1.5 U) (Sigma). TPP concentration was varied. The oxidation of NADH was monitored at 340 nm in a 1 cm path length cuvette on a Cary 300 spectrophotometer (Agilent Technologies, Wilmington Del.) The enzyme rate was calculated using the molar extinction coefficient of 6220 $M^{-1}$ $cm^{-1}$ for NADH. Controls at various concentrations of hADH and cell free extract ensured that measured rate was determined by KIVD enzyme activity.

The specific activities of the putative KIVD enzymes expressed in E. coli were calculated from measured enzyme activities and total protein concentrations. These specific activities were plotted against TPP concentration. Using Kaleidagraph (Synergy), the resulting curves were fit to the saturation equation $(SA=(SA_{max}*[TPP])/(K_c+[TPP]))+C)$. The TPP cofactor activation constants ($K_c$) were determined and values are listed in Table 10.

TABLE 10

TPP Cofactor Activation Constants for KivD Putatives

| ID | Activation Constant $K_c$, µM |
|---|---|
| KivD80 | 50 |
| kivD81 | 0.79 |
| Mca | 0.53 |
| KdcA | 0.81 |
| KivD | 73.4 |

Example 5

KIVD Activity of Selected Round 2 Enzymes Following Expression in E. coli with Thiamine Supplemented Media Based on sequence homology to enzymes that possess KIVD activity, five of the round 2 candidates were analyzed further. Vector without an insert and Mca were employed as negative and positive controls, respectively. Expression in E. coli was performed as described in Example 2, with the modification that 30 mg/L thiamine hydrochloride (Sigma) was supplemented in the growth media. Crude extracts were prepared and assayed as described in Example 3. SDS-PAGE analysis indicated that Npu was expressed in E. coli as an insoluble protein.

TABLE 11

KIVD activities for enzymes expressed with thiamine supplemented media

| ID | Specific Activity (U/mg) |
|---|---|
| Npu | <0.1 |
| Bme | 2.17 |
| Sve | 0.50 |
| Hmu | 1.25 |
| Cac | 0.81 |
| Mca | 73.7 |
| Vector control | <0.1 |

Example 6

Measurement of Substrate Specificity Ratios

Two putative KIVD enzymes (KivD81, Mca), KdcA and Lactis KivD, were evaluated for substrate preference. Plasmids (see examples 1 and 2 for plasmid description) encoding for each of the enzymes were isolated and transformed into electrocompetent KEIO Aldh strain of E. coli (Open Biosystems, Huntsville, Ala.). Following shake flask growth at 30° C. to OD600 nm=0.5 in LB media supplemented with 100 ug ampicillin/mL, 1 mM IPTG was added and the cultures grown for an additional 14-16 hrs. Crude cell lysates were generated as follows and the putative KivD enzymes were analyzed in regard to activity with aKiv and pyruvate.

Preparation of Cell Free Extract

E. coli cells were suspended in 3 mL of 100 mM HEPES, pH 6.8, 10 mM $MgCl_2$ and broken by sonication at 0° C. The cells were sonicated with a probe for 10 seconds, with 25 seconds of rest. This cycle was repeated 12 times, for a total of 2 minutes of sonication. The crude extract from the broken cells was centrifuged to pellet the cell debris. The supernatants were removed and stored on ice until assayed.

Protein Quantification

The total protein concentration in cell free extracts was measured by the Bradford Assay using Coomassie Plus (Thermo Scientific #23238, Rockford, Ill.). BSA was employed as a standard. The concentration of protein was measured by following absorbance at 595 nm using a Cary 50 spectrophotometer (Agilent Technologies, Wilmington Del.).

KIVD Enzyme Assay Protocol—Coupled

The rates for the conversion of ketoisovalerate to isobutryaldehyde were measured in a horse liver ADH (hADH) coupled enzyme assay, which has been described in Gocke, D. et al. (Adv. Synth. Catal. 2007, 349, 1425-1435). Assays of cell free extracts were performed at 30° C. in buffer containing 100 mM HEPES pH 6.8, 10 mM $MgCl_2$, 200 μM NADH, 500 μM TPP, and 0.45 U hADH (1 mg=1.5 U) (Sigma). The substrate, pyruvate (Sigma) or αKIV (Sigma) was added at various concentrations. The oxidation of NADH was monitored at 340 nm in a 1 cm path length cuvette on a Cary 300 spectrophotometer (Agilent Technologies, Wilmington Del.) The enzyme rate was calculated using the molar extinction coefficient of 6220 $M^{-1}$ $cm^{-1}$ for NADH. Controls at various concentrations of hADH and cell free extract ensured that measured rate was determined by KIVD enzyme activity.

The specific activities of the putative KIVD enzymes expressed in E. coli were calculated from measured enzyme activities and total protein concentrations. These specific activities were plotted against the appropriate substrate. Using Kaleidagraph (Synergy), the resulting curves were fit to the Michaelis-Menton equation and $K_m$ and $V_{max}$ were determined. Kinetic values and specificity ratio ($[(V_{max}/K_m)\alpha Kiv]/[(V_{max}/K_m)pyruvate]$) are listed in Table 12.

Example 7

Construction of PNY1503(BP1064)

Construction of Saccharomyces cerevisiae Strain BP1064 (PNY1503)

The strain BP1064 was derived from CEN.PK 113-7D (CBS 8340; Centraalbureau voor Schimmelcultures (CBS) Fungal Biodiversity Centre, Netherlands) and contains deletions of the following genes: URA3, HIS3, PDC1, PDC5, PDC6, and GPD2.

Deletions, which completely removed the entire coding sequence, were created by homologous recombination with PCR fragments containing regions of homology upstream and downstream of the target gene and either a G418 resistance marker or URA3 gene for selection of transformants. The G418 resistance marker, flanked by loxP sites, was removed using Cre recombinase (pRS423::PGAL1-cre; SEQ ID NO: 71). The URA3 gene was removed by homologous recombination to create a scarless deletion, or if flanked by loxP sites was removed using Cre recombinase.

The scarless deletion procedure was adapted from Akada et al., Yeast, 23:399, 2006. In general, the PCR cassette for each scarless deletion was made by combining four fragments, A-B-U-C, by overlapping PCR. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene). Fragments A and C corresponded to the 500 bp immediately upstream of the target gene (Fragment A) and the 500 bp of the 3' end of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome. Using the PCR product ABUC cassette, the URA3 marker was first integrated into and then excised from the chromosome by homologous recombination. The initial integration deleted the gene, excluding the 3' 500 bp. Upon excision, the 3' 500 bp region of the gene was also deleted. For integration of genes using this method, the gene to be integrated was included in the PCR cassette between fragments A and B.

URA3 Deletion

To delete the endogenous URA3 coding region, a ura3::loxP-kanMX-loxP cassette was PCR-amplified from pLA54 template DNA (SEQ ID NO:72). pLA54 contains the K. lactis TEF1 promoter and kanMX marker, and is flanked by loxP sites to allow recombination with Cre recombinase and removal of the marker. PCR was done using Phusion DNA

TABLE 12

Kinetic Values of KivD Putatives

| | a-KIV | | | pyruvate | | | |
|---|---|---|---|---|---|---|---|
| ID | Km, mM | Vmax, U/mg | Vmax/Km, ml/(min * mg) | Km, mM | Vmax, U/mg | Vmax/Km, ml/(min * mg) | Specificity Ratio (α-Kiv/Pyruvate) |
| Mca | 0.7 | 4.0 | 5.6 | 4.3 | 0.1 | 0.03 | 193.7 |
| Lactis | 2.5 | 43.2 | 17.5 | 16.5 | 0.9 | 0.05 | 320.9 |
| KdcA | 2.2 | 24.5 | 11.2 | 16.0 | 0.5 | 0.03 | 356.6 |
| KivD 81 | 1.4 | 5.5 | 3.9 | 15.7 | 0.2 | 0.02 | 255.3 | polymerase and primers BK505 and BK506 (SEQ ID NOs:73 and 74). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 µg/ml) at 30° C. Transformants were screened to verify correct integration by PCR using primers LA468 and LA492 (SEQ ID NOs:75 and 76) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 77) and primer oBP453 (SEQ ID NO: 78), containing a 5' tail with homology to the 5' end of HIS3 Fragment B. HIS3 Fragment B was amplified with primer oBP454 (SEQ ID NO: 79), containing a 5' tail with homology to the 3' end of HIS3 Fragment A, and primer oBP455 (SEQ ID NO: 80), containing a 5' tail with homology to the 5' end of HIS3 Fragment U. HIS3 Fragment U was amplified with primer oBP456 (SEQ ID NO: 81), containing a 5' tail with homology to the 3' end of HIS3 Fragment B, and primer oBP457 (SEQ ID NO: 82), containing a 5' tail with homology to the 5' end of HIS3 Fragment C. HIS3 Fragment C was amplified with primer oBP458 (SEQ ID NO: 83), containing a 5' tail with homology to the 3' end of HIS3 Fragment U, and primer oBP459 (SEQ ID NO: 84). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 77) and oBP455 (SEQ ID NO: 80). HIS3 Fragment UC was created by overlapping PCR by mixing HIS3 Fragment U and HIS3 Fragment C and amplifying with primers oBP456 (SEQ ID NO: 81) and oBP459 (SEQ ID NO: 84). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 77) and oBP459 (SEQ ID NO: 84). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO: 85) and oBP461 (SEQ ID NO: 86) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 71) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoro-orotic acid (0.1%) at 30° C. to select for isolates that lost the URA3 marker. 5-FOA resistant isolates were grown in and plated on YPD for removal of the pRS423::PGAL1-cre plasmid. Isolates were checked for loss of the KanMX marker, URA3 marker, and pRS423::PGAL1-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO: 87) and oBP451 (SEQ ID NO: 88) for Δura3 and primers oBP460 (SEQ ID NO: 85) and oBP461 (SEQ ID NO: 86) for Δhis3 using genomic DNA prepared with a Gentra Puregene Yeast/Bact kit (Qiagen).

PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO: 89) and primer oBP441 (SEQ ID NO: 90), containing a 5' tail with homology to the 5' end of PDC6 Fragment B. PDC6 Fragment B was amplified with primer oBP442 (SEQ ID NO: 91), containing a 5' tail with homology to the 3" end of PDC6 Fragment A, and primer oBP443 (SEQ ID NO: 92), containing a 5' tail with homology to the 5' end of PDC6 Fragment U. PDC6 Fragment U was amplified with primer oBP444 (SEQ ID NO: 93), containing a 5' tail with homology to the 3' end of PDC6 Fragment B, and primer oBP445 (SEQ ID NO: 94), containing a 5' tail with homology to the 5' end of PDC6 Fragment C. PDC6 Fragment C was amplified with primer oBP446 (SEQ ID NO: 95), containing a 5' tail with homology to the 3' end of PDC6 Fragment U, and primer oBP447 (SEQ ID NO: 96). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO: 89) and oBP443 (SEQ ID NO: 92). PDC6 Fragment UC was created by overlapping PCR by mixing PDC6 Fragment U and PDC6 Fragment C and amplifying with primers oBP444 (SEQ ID NO: 93) and oBP447 (SEQ ID NO: 96). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO: 89) and oBP447 (SEQ ID NO: 96). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO: 97) and oBP449 (SEQ ID NO: 98) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 97) and oBP449 (SEQ ID NO: 98) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO: 99) and oBP555 (SEQ ID NO: 100). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610. The A fragment followed by the ilvD coding region from *Streptococcus mutans* for the PCR cassette for the PDC1 deletion-ilvDSm integration was amplified using Phusion High Fidelity PCR Master Mix (New England BioLabs) and NYLA83 (described in U.S. App. Pub. No. 20110124060, incorporated herein by reference in its entirety) genomic DNA as template, prepared with a Gentra Puregene Yeast/Bact kit (Qiagen). (NYLA83 is a strain that carries the PDC1 deletion ilvDSm integration described in U.S. Patent Application Publication No. 2009/0305363, which is herein incorporated by reference in its entirety.) PDC1 Fragment A-ilvDSm (SEQ ID NO: 101) was amplified with primer oBP513 (SEQ ID NO: 102) and primer oBP515 (SEQ ID NO: 103), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO: 104) containing a 5' tail with homology to the 3' end of PDC1 Fragment A-ilvDSm, and primer oBP517 (SEQ ID NO: 105), containing a 5' tail with homology to the 5' end of PDC1 Fragment U. PDC1 Fragment U was amplified with primer oBP518 (SEQ ID NO: 106), containing a 5' tail with homology to the 3' end of PDC1 Fragment B, and primer oBP519 (SEQ ID NO: 107), containing a 5' tail with homology to the 5' end of PDC1 Fragment C. PDC1 Fragment C was amplified with primer oBP520 (SEQ ID NO: 108), containing a 5' tail with homology to the 3' end of PDC1 Fragment U, and primer oBP521 (SEQ ID NO: 109). PCR products were purified with a PCR Purification kit (Qiagen). PDC1 Fragment A-ilvDSm-B was created by overlapping PCR by mixing PDC1 Fragment A-ilvDSm and PDC1 Fragment B and amplifying with primers oBP513 (SEQ ID NO: 102) and oBP517 (SEQ ID NO: 105). PDC1 Fragment UC was created by overlapping PCR by mixing PDC1 Fragment U and PDC1 Fragment C and amplifying with primers oBP518 (SEQ ID NO: 106) and oBP521 (SEQ ID NO: 109). The resulting PCR products were purified on an agarose gel followed by a Gel Extraction kit (Qiagen). The PDC1 A-ilvDSm-BUC cassette was created by overlapping PCR by mixing PDC1 Fragment A-ilvDSm-B and PDC1 Fragment UC and amplifying with primers oBP513 (SEQ ID NO: 102) and oBP521 (SEQ ID NO: 109). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30° C. Transformants with a pdc1 knockout ilvDSm integration were screened for by PCR with primers oBP511 (SEQ ID NO: 110) and oBP512 (SEQ ID NO: 111) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO:112) and oBP551 (SEQ ID NO:113). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO:110) and oBP512 (SEQ ID NO:111) using genomic DNA prepared with a Gentra Puregene Yeast/Bact kit (Qiagen). The correct isolate was selected as strain CEN.PK 113-7D Δura3::loxP Δhis3 Δpdc6 Δpdc1:: ilvDSm and designated as BP907.

PDC5 Deletion sadB Integration

The PDC5 gene was deleted and replaced with the sadB coding region from *Achromobacter xylosoxidans* (The sadB gene is described in U.S. Patent Appl. Pub. No. 2009/0269823, which is herein incorporated by reference in its entirety). A segment of the PCR cassette for the PDC5 deletion-sadB integration was first cloned into plasmid pUC19-URA3MCS.

pUC19-URA3MCS is pUC19 based and contains the sequence of the URA3 gene from *Saccharomyces cerevisiae* situated within a multiple cloning site (MCS). pUC19 contains the pMB1 replicon and a gene coding for beta-lactamase for replication and selection in *Escherichia coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccharomyces cerevisiae* CEN.PK 113-7D genomic DNA was amplified with primers oBP438 (SEQ ID NO: 114), containing BamHI, AscI, PmeI, and FseI restriction sites, and oBP439 (SEQ ID NO: 115), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 (SEQ ID NO: 116) were ligated with T4 DNA ligase after digestion with BamHI and XbaI to create vector pUC19-URA3MCS. The vector was confirmed by PCR and sequencing with primers oBP264 (SEQ ID NO: 117) and oBP265 (SEQ ID NO: 118).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO: 119) as template with primer oBP530 (SEQ ID NO: 120), containing an AscI restriction site, and primer oBP531 (SEQ ID NO: 121), containing a 5' tail with homology to the 5' end of PDC5 Fragment B. PDC5 Fragment B was amplified with primer oBP532 (SEQ ID NO: 122), containing a 5' tail with homology to the 3' end of sadB, and primer oBP533 (SEQ ID NO:123), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO: 120) and oBP533 (SEQ ID NO: 123). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO: 124) and oBP546 (SEQ ID NO: 125), containing a 5' tail with homology to the 5' end of PDC5 Fragment C. PDC5 Fragment C was amplified with primer oBP547 (SEQ ID NO: 126) containing a 5' tail with homology to the 3' end of PDC5 sadB-Fragment B-Fragment U, and primer oBP539 (SEQ ID NO: 127). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO: 124) and oBP539 (SEQ ID NO: 127). The resulting PCR product was purified on an agarose gel followed by a Gel Extraction kit (Qiagen). The PDC5 A-sadB-BUC cassette (SEQ ID NO: 128) was created by amplifying PDC5 sadB-Fragment B-Fragment U-Fragment C with primers oBP542 (SEQ ID NO: 129), containing a 5' tail with homology to the 50 nucleotides immediately upstream of the native PDC5 coding sequence, and oBP539 (SEQ ID NO: 127). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30° C. Transformants with a pdc5 knockout sadB integration were screened for by PCR with primers oBP540 (SEQ ID NO: 130) and oBP541 (SEQ ID NO: 131) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO: 132) and oBP553 (SEQ ID NO: 133). A correct transformant was selected as strain CEN.PK 113-7D Δura3::loxP Δhis3 Δpdc6 Δpdc1::ilvDSm Δpdc5::sadB-URA3.

CEN.PK 113-7D &ura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of sadB, and marker removal were confirmed by PCR with primers oBP540 (SEQ ID NO: 130) and oBP541 (SEQ ID NO: 131) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO: 134) was PCR-amplified using loxP-URA3-loxP PCR (SEQ ID NO: 135) as template DNA. loxP-URA3-loxP contains the URA3 marker from (ATCC #77107) flanked by loxP recombinase sites. PCR was done using Phusion DNA polymerase and primers LA512 and LA513 (SEQ ID NOs: 136 and 137). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 and AA270 (SEQ ID NOs:138 and 139).

The URA3 marker was recycled by transformation with pRS423::PGAL1-cre (SEQ ID NO: 71) and plating on synthetic complete media lacking histidine supplemented with 1% ethanol at 30 C. Transformants were streaked on synthetic complete medium supplemented with 1% ethanol and containing 5-fluoro-orotic acid (0.1%) and incubated at 30 C to select for isolates that lost the URA3 marker. 5-FOA resistant isolates were grown in YPE (1% ethanol) for removal of the pRS423::PGAL1-cre plasmid. The deletion and marker removal were confirmed by PCR with primers oBP582 (SEQ ID NO: 138) and oBP591 (SEQ ID NO: 140). The correct isolate was selected as strain CEN.PK 113-7D Δura3::loxP Δhis3 Δpdc6 Δpdc1::ilvDSm Δpdc5::sadB Δgpd2::loxP and designated as BP1064 (PNY1503).

Example 8

Construction of PNY1507

Construction of Saccharomyces cerevisiae Strains BP1135 (PNY1505) and PNY1507 and Isobutanol-Producing Derivatives The purpose of this Example was to construct Saccharomyces cerevisiae strains BP1135 and PNY1507. These strains were derived from PNY1503 (BP1064). The construction of PNY1503 (BP1064) is described above. BP1135 contains an additional deletion of the FRA2 gene. PNY1507 was derived from BP1135 with additional deletion of the ADH1 gene, with integration of the kivD gene from Lactococcus lactis, codon optimized for expression in Saccharomyces cerevisiae, into the ADH1 locus.

FRA2 Deletion

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO: 141) and primer oBP595 (SEQ ID NO: 142), containing a 5' tail with homology to the 5' end of FRA2 Fragment B. FRA2 Fragment B was amplified with primer oBP596 (SEQ ID NO: 143), containing a 5' tail with homology to the 3' end of FRA2 Fragment A, and primer oBP597 (SEQ ID NO: 144), containing a 5' tail with homology to the 5' end of FRA2 Fragment U. FRA2 Fragment U was amplified with primer oBP598 (SEQ ID NO: 145), containing a 5' tail with homology to the 3' end of FRA2 Fragment B, and primer oBP599 (SEQ ID NO: 146), containing a 5' tail with homology to the 5' end of FRA2 Fragment C. FRA2 Fragment C was amplified with primer oBP600 (SEQ ID NO: 147), containing a 5' tail with homology to the 3' end of FRA2 Fragment U, and primer oBP601 (SEQ ID NO: 148). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 141) and oBP597 (SEQ ID NO: 144). FRA2 Fragment UC was created by overlapping PCR by mixing FRA2 Fragment U and FRA2

Fragment C and amplifying with primers oBP598 (SEQ ID NO: 145) and oBP601 (SEQ ID NO: 148). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 141) and oBP601 (SEQ ID NO: 148). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research; Orange, Calif.). Transformation mixtures were plated on synthetic complete media lacking uracil supplemented with 1% ethanol at 30° C. Transformants with a fra2 knockout were screened for by PCR with primers oBP602 (SEQ ID NO:149) and oBP603 (SEQ ID NO: 150) using genomic DNA prepared with a Gentra Puregene Yeast/Bact kit (Qiagen). A correct transformant was grown in YPE (yeast extract, peptone, 1% ethanol) and plated on synthetic complete medium containing 5-fluoro-orotic acid (0.1%) at 30° C. to select for isolates that lost the URA3 marker. The deletion and marker removal were confirmed by PCR with primers oBP602 (SEQ ID NO: 149) and oBP603 (SEQ ID NO: 150) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO: 151) and oBP606 (SEQ ID NO: 152). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135). This strain was transformed with isobutanol pathway plasmids (pYZ090, SEQ ID NO: 69) and pLH468 (SEQ ID NO: 70), and one clone was designated BP1168 (PNY1506).

ADH1 Deletion and kivD LI(y) Integration

The ADH1 gene was deleted and replaced with the kivD coding region from *Lactococcus lactis* codon optimized for expression in *Saccharomyces cerevisiae*. The scarless cassette for the ADH1 deletion-kivD_LI(y) integration was first cloned into plasmid pUC19-URA3MCS.

The kivD coding region from *Lactococcus lactis* codon optimized for expression in *Saccharomyces cerevisiae* was amplified using pLH468 (SEQ ID NO: 70) as template with primer oBP562 (SEQ ID NO: 153), containing a PmeI restriction site, and primer oBP563 (SEQ ID NO: 154), containing a 5' tail with homology to the 5' end of ADH1 Fragment B. ADH1 Fragment B was amplified from genomic DNA prepared as above with primer oBP564 (SEQ ID NO: 155), containing a 5' tail with homology to the 3' end of kivD_LI(y), and primer oBP565 (SEQ ID NO: 156), containing a FseI restriction site. PCR products were purified with a PCR Purification kit (Qiagen). kivD_LI(y)-ADH1 Fragment B was created by overlapping PCR by mixing the kivD_LI(y) and ADH1 Fragment B PCR products and amplifying with primers oBP562 (SEQ ID NO: 153) and oBP565 (SEQ ID NO: 156). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 157), containing a SacI restriction site, and primer oBP506 (SEQ ID NO: 158), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO: 159), containing a PacI restriction site, and primer oBP508 (SEQ ID NO: 160), containing a SalI restriction site. The ADH1 Fragment C PCR product was digested with PacI and SalI and ligated with T4 DNA ligase into the corresponding sites of the plasmid containing ADH1 Fragment A-kivD_LI(y)-ADH1 Fragment B. The hybrid promoter UAS(PGK1)-$P_{FBA1}$ was amplified from vector pRS316-UAS(PGK1)-$P_{FBA1}$-GUS (SEQ ID NO: 161) with primer oBP674 (SEQ ID NO: 162), containing an AscI restriction site, and primer oBP675 (SEQ ID NO: 163), containing a PmeI restriction site. The UAS(PGK1)-$P_{FBA1}$ PCR product was digested with AscI and PmeI and ligated with T4 DNA ligase into the corresponding sites of the plasmid containing kivD_LI(y)-ADH1 Fragments ABC. The entire integration cassette was amplified from the resulting plasmid with primers oBP505 (SEQ ID NO: 157) and oBP508 (SEQ ID NO: 160) and purified with a PCR Purification kit (Qiagen).

Competent cells of PNY1505 were made and transformed with the ADH1-kivD_LI(y) PCR cassette constructed above using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium containing 5-fluoro-orotic acid (0.1%) at 30° C. to select for isolates that lost the URA3 marker. The deletion of ADH1 and integration of kivD_LI(y) were confirmed by PCR with external primers oBP495 (SEQ ID NO: 164) and oBP496 (SEQ ID NO: 165) and with kivD_LI(y) specific primer oBP562 (SEQ ID NO: 153) and external primer oBP496 (SEQ ID NO: 165) using genomic DNA prepared with a Gentra Puregene Yeast/Bact kit (Qiagen). The correct isolate was selected as strain CEN.PK 113-7D MATa ura3Δ::loxP his3Δ pdc6Δ pdc1Δ::P[PDC1]-DHAD|ilvD_Sm-PDC1tpdc5Δ::P[PDC5]-ADH|sadB_Ax-PDC5t gpd2Δ::loxP fra2Δ adh1Δ::UAS(PGK1)P[FBA1]-kivD_LI(y)-ADH1t and designated as PNY1507 (BP1201).

Example 9

Construction of PNY2211

Construction of *S. cerevisiae* Strain PNY2211 and PNY2209

PNY2211 was constructed in several steps from *S. cerevisiae* strain PNY1507 as described in the following paragraphs. First the strain was modified to contain a phosphoketolase gene. Next, an acetolactate synthase gene (alsS) was added to the strain, using an integration vector targeted to sequence adjacent to the phosphoketolase gene. Finally, homologous recombination was used to remove the phosphoketolase gene and integration vector sequences, resulting in a scarless insertion of alsS in the intergenic region between pdc1Δ::ilvD and the native TRX1 gene of chromosome XII. The resulting genotype of PNY2211 is MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH| sadB_Ax-PDC5t gpd2Δ::loxP fra2Δ adh1Δ::UAS(PGK1)P[FBA1]-kivD_LI(y)-ADH1t.

A phosphoketolase gene cassette was introduced into PNY1507 by homologous recombination. The integration construct was generated as follows. The plasmid pRS423::CUP1-alsS+FBA-budA (previously described in US2009/0305363, which is herein incorporated by reference in its entirety) was digested with NotI and XmaI to remove the 1.8 kb FBA-budA sequence, and the vector was religated after treatment with Klenow fragment. Next, the CUP1 promoter was replaced with a TEF1 promoter variant (M4 variant previously described by Nevoigt et al. *Appl. Environ.* Microbiol. 72: 5266-5273 (2006), which is herein incorporated by reference in its entirety) via DNA synthesis and vector construction service from DNA2.0 (Menlo Park, Calif.). The resulting plasmid, pRS423::TEF(M4)-alsS was cut with StuI and MluI (removes 1.6 kb portion containing part of the alsS gene and CYC1 terminator), combined with the 4 kb PCR product generated from pRS426::GPD-xpk1+ADH-eutD (SEQ ID NO: 167) with primers N1176 (SEQ ID NO: 168) and N1177 (SEQ ID NO: 169) and an 0.8 kb PCR product DNA generated from yeast genomic DNA (ENO1 promoter region) with primers N822 (SEQ ID NO: 170) and N1178 (SEQ ID NO: 171) and transformed into *S. cerevisiae* strain BY4741 (ATCC #201388); gap repair cloning methodology, see Ma et al. *Gene* 58:201-216 (1987). Transformants were obtained by plating cells on synthetic complete medium without histidine. Proper assembly of the expected plasmid (pRS423::TEF (M4)-xpk1+ENO1-eutD, SEQ ID NO: 172) was confirmed by PCR (primers N821 (SEQ ID NO: 173) and N1115 (SEQ ID NO: 174)) and by restriction digest (BglI). Two clones were subsequently sequenced. The 3.1 kb TEF(M4)-xpk1 gene was isolated by digestion with SacI and NotI and cloned into the pUC19-URA3::ilvD-TRX1 vector (Clone A, cut with AflII). Cloning fragments were treated with Klenow fragment to generate blunt ends for ligation. Ligation reactions were transformed into *E. coli* StbI3 cells, selecting for ampicillin resistance. Insertion of TEF(M4)-xpk1 was confirmed by PCR (primers N1110 (SEQ ID NO: 175) and N1114 (SEQ ID NO: 176)). The vector was linearized with AflII and treated with Klenow fragment. The 1.8 kb KpnI-HincII geneticin resistance cassette was cloned by ligation after Klenow fragment treatment. Ligation reactions were transformed into *E. coli* StbI3 cells, selecting for ampicillin resistance. Insertion of the geneticin cassette was confirmed by PCR (primers N160SeqF5 (SEQ ID NO: 183) and BK468 (SEQ ID NO: 178)). The plasmid sequence is provided as SEQ ID NO: 179 (pUC19-URA3::pdc1::TEF(M4)-xpk1::kan).

The resulting integration cassette (pdc1::TEF(M4)-xpk1:: KanMX::TRX1) was isolated (AscI and NaeI digestion generated a 5.3 kb band that was gel purified) and transformed into PNY1507 using the Zymo Research Frozen-EZ Yeast Transformation Kit (Cat. No. T2001). Transformants were selected by plating on YPE plus 50 μg/ml G418. Integration at the expected locus was confirmed by PCR (primers N886 (SEQ ID NO: 180) and N1214 (SEQ ID NO: 181)). Next, plasmid pRS423::GAL1p-Cre (SEQ ID NO: 71), encoding Cre recombinase, was used to remove the loxP-flanked KanMX cassette. Proper removal of the cassette was confirmed by PCR (primers oBP512 (SEQ ID NO: 111) and N160SeqF5 (SEQ ID NO: 177)). Finally, the alsS integration plasmid (SEQ ID NO: 225, pUC19-kan::pdc1::FBA-alsS:: TRX1, clone A) was transformed into this strain using the included geneticin selection marker. Two integrants were tested for acetolactate synthase activity by transformation with plasmids pYZ090ΔalsS (SEQ ID NO: 182) and pBP915 (SEQ ID NO: 166) (transformed using Protocol #2 in Amberg, Burke and Strathern "Methods in Yeast Genetics" (2005)), and evaluation of growth and isobutanol production in glucose-containing media (methods for growth and isobutanol measurement are as follows: All strains were grown in synthetic complete medium, minus histidine and uracil containing 0.3% glucose and 0.3% ethanol as carbon sources (10 mL medium in 125 mL vented Erlenmeyer flasks (VWR Cat. No. 89095-260). After overnight incubation (30° C., 250 rpm in an Innova®40 New Brunswick Scientific Shaker), cultures were diluted back to 0.2 OD (Eppendorf BioPhotometer measurement) in synthetic complete medium containing 2% glucose and 0.05% ethanol (20 ml medium in 125 mL tightly-capped Erlenmeyer flasks (VWR Cat. No. 89095-260)). After 48 hours incubation (30° C., 250 rpm in an Innova®40 New Brunswick Scientific Shaker), culture supernatants (collected using Spin-X centrifuge tube filter units, Costar Cat. No. 8169) were analyzed by HPLC per methods described in U.S. Appl. Pub. No. 20070092957).). One of the two clones was positive and was named PNY2218.

PNY2218 was treated with Cre recombinase, and the resulting clones were screened for loss of the xpk1 gene and pUC19 integration vector sequences by PCR (primers N886 (SEQ ID NO: 180) and N160SeqR5 (SEQ ID NO: 183)). This left only the alsS gene integrated in the pdc1-TRX1 intergenic region after recombination of the DNA upstream of xpk1 and the homologous DNA introduced during insertion of the integration vector (a "scarless" insertion since vector, marker gene and loxP sequences are lost). Although this recombination could have occurred at any point, the vector integration appeared to be stable even without geneticin selection, and the recombination event was only observed after introduction of the Cre recombinase. One clone was designated PNY2211.

Example 10

Construction of PNY1528

PNY1528 (hADH Integrations in PNY2211)

Deletions/integrations were created by homologous recombination with PCR products containing regions of homology upstream and downstream of the target region and the URA3 gene for selection of transformants. The URA3 gene was removed by homologous recombination to create a scarless deletion/integration.

The scarless deletion/integration procedure was adapted from Akada et al., *Yeast,* 23:399 (2006). The PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (each approximately 100 to 500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

YPRCΔ15 Deletion and Horse Liver Adh Integration

The YPRCΔ15 locus was deleted and replaced with the horse liver adh gene, codon optimized for expression in *Saccharomyces cerevisiae*, along with the PDC5 promoter region (538 bp) from *Saccharomyces cerevisiae* and the ADH1 terminator region (316 bp) from *Saccharomyces cerevisiae*. The scarless cassette for the YPRCΔ15 deletion-P[PDC5]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCΔ15 Fragment A was amplified from genomic DNA with primer oBP622 (SEQ ID NO: 184), containing a KpnI restriction site, and primer oBP623 (SEQ ID NO: 185), containing a 5' tail with homology to the 5' end of YPRCΔ15 Fragment B. YPRCΔ15 Fragment B was amplified from genomic DNA with primer oBP624 (SEQ ID NO: 186), containing a 5' tail with homology to the 3' end of YPRCΔ15 Fragment A, and primer oBP625 (SEQ ID NO: 187), containing a FseI restriction site. PCR products were purified with a PCR Purification kit (Qiagen). YPRCΔ15 Fragment A—YPRCΔ15 Fragment B was created by overlapping PCR by mixing the YPRCΔ15 Fragment A and YPRCΔ15 Fragment B PCR products and amplifying with primers oBP622 (SEQ ID NO: 184) and oBP625 (SEQ ID NO: 187). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 188), containing a NotI restriction site, and primer oBP627 (SEQ ID NO: 189), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 190), containing an AscI restriction site, and primer HY24 (SEQ ID NO: 191), containing a 5' tail with homology to the 5' end of adh_HI(y). adh_HI(y)-ADH1t was amplified from pBP915 (SEQ ID NO: 166) with primers HY25 (SEQ ID NO: 192), containing a 5' tail with homology to the 3' end of P[PDC5], and HY4 (SEQ ID NO: 193), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 190) and HY4 (SEQ ID NO: 193). The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 184) and oBP627 (SEQ ID NO: 189).

Competent cells of PNY2211 were made and transformed with the YPRCΔ15 deletion-P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were screened for by PCR with primers URA3-end F (SEQ ID NO: 194) and oBP637 (SEQ ID NO: 195). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of YPRCΔ15 and integration of P[PDC5]-adh_HL(y)-ADH1t were confirmed by PCR with external primers oBP636 (SEQ ID NO: 124) and oBP637 (SEQ ID NO: 195) using genomic DNA prepared with a YeaStar Genomic DNA kit (Zymo Research). A correct isolate of the following genotype was selected for further modification: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_LI(y)ADH it yprcΔ15Δ::P[PDC5]-ADH|adh_HI-ADH1t.

Horse Liver Adh Integration at Fra2

The horse liver adh gene, codon optimized for expression in *Saccharomyces cerevisiae*, along with the PDC1 promoter region (870 bp) from *Saccharomyces cerevisiae* and the ADH1 terminator region (316 bp) from *Saccharomyces cerevisiae*, was integrated into the site of the fra2 deletion. The scarless cassette for the fra2Δ-P[PDC1]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 197), containing a NotI restriction site, and primer oBP696 (SEQ ID NO: 198), containing a PacI restriction site. The fra2Δ Fragment C PCR product was digested with NotI and PacI and ligated with T4 DNA ligase into the corresponding sites of pUC19-URA3MCS. fra2Δ Fragment B was amplified from genomic DNA with primer oBP693 (SEQ ID NO: 199), containing a PmeI restriction site, and primer oBP694 (SEQ ID NO: 200), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 201), containing BamHI and AsiSI restriction sites, and primer oBP692 (SEQ ID NO: 202), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 203), containing an AscI restriction site, and primer HY19 (SEQ ID NO: 204), containing a 5' tail with homology to the 5' end of adh_HI(y). adh_HI(y)-ADH1t was amplified from pBP915 with primers HY20 (SEQ ID NO: 205), containing a 5' tail with homology to the 3' end of P[PDC1], and HY4 (SEQ ID NO: 193), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)ADH1t PCR products and amplifying with primers HY16 (SEQ ID NO: 203) and HY4 (SEQ ID NO: 193). The resulting PCR product was digested with AscI and PmeI and ligated with T4 DNA ligase into the corresponding sites of the plasmid containing fra2Δ Fragments ABC. The entire integration cassette was amplified from the resulting plasmid with primers oBP691 (SEQ ID NO: 201) and oBP696 (SEQ ID NO: 198).

Competent cells of the PNY2211 variant with adh_HI(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30 C. Transformants were screened for by PCR with primers URA3-end F (SEQ ID NO: 194) and oBP731 (SEQ ID NO: 206). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The integration of P[PDC1]-adh_HL(y)-ADH1t was confirmed by colony PCR with internal primer HY31 (SEQ ID NO: 207) and external primer oBP731 (SEQ ID NO: 155) and PCR with external primers oBP730 (SEQ ID NO: 208) and oBP731 (SEQ ID NO: 206) using genomic DNA prepared with a YeaStar Genomic DNA kit (Zymo Research). A correct isolate of the following genotype was designated PNY1528: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_LI(y)ADH1t yprcΔ15Δ::P[PDC5]-ADH|adh_HI-ADH1t.

Example 11

Construction of Strains PNY1549, PNY1550, and PNY1551

The purpose of this example is to describe the assembly of the constructs used to replace the chromosomal copy of kivD_LI(y) in PNY1528 at the adh1Δ locus with kivD_Lg(y) or kivD_Mc(y) and construction of isobutanologen strains PNY1549, PNY1550, and PNY1551 expressing the kivD genes.

Deletions/integrations were created by homologous recombination with PCR products containing regions of homology upstream and downstream of the target region and the URA3 gene for selection of transformants. The URA3 gene was removed by homologous recombination to create a scarless deletion/integration. The scarless deletion/integration procedure was adapted from Akada et al., Yeast, 23:399, 2006. The PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

The plasmids to integrate kivD_Lg(y) and kivD_Mc(y) were derived from a plasmid constructed to integrate UAS(PGK1)P[FBA1]-kivD_LI(y) into the ADH1 locus of Saccharomyces cerevisiae. Construction of the plasmid used to integrate UAS(PGK1)P[FBA1]-kivD_LI(y) into the ADH1 locus is described below. The plasmids were constructed in pUC19-URA3MCS.

Construction of the ADH1 Deletion/UAS(PGK1)P[FBA1]-kivD_LI(y) Integration Plasmid The kivD coding region from Lactococcus lactis codon optimized for expression in Saccharomyces cerevisiae, kivD_LI(y), was amplified using pLH468 (SEQ ID NO: 70) as template with primer oBP562 (SEQ ID NO: 153), containing a PmeI restriction site, and primer oBP563 (SEQ ID NO: 154), containing a 5' tail with homology to the 5' end of ADH1 Fragment B. ADH1 Fragment B was amplified from Saccharomyces cerevisiae CEN.PK 113-7D genomic DNA with primer oBP564 (SEQ ID NO: 155), containing a 5' tail with homology to the 3' end of kivD_LI(y), and primer oBP565 (SEQ ID NO: 156), containing a FseI restriction site. PCR products were purified with a PCR Purification kit (Qiagen; Valencia, Calif.). kivD_LI(y)-ADH1 Fragment B was created by overlapping PCR by mixing the kivD_LI(y) and ADH1 Fragment B PCR products and amplifying with primers oBP562 (SEQ ID NO: 153) and oBP565 (SEQ ID NO 156). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 157), containing a SacI restriction site, and primer oBP506 (SEQ ID NO: 158), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO: 159), containing a PacI restriction site, and primer oBP508 (SEQ ID NO: 160), containing a SalI restriction site. The ADH1 Fragment C PCR product was digested with PacI and SalI and ligated with T4 DNA ligase into the corresponding sites of the plasmid containing ADH1 Fragment A-kivD_LI(y)-ADH1 Fragment B. The hybrid promoter UAS(PGK1)-P$_{FBA1}$ (SEQ ID NO: 161) was amplified from vector pRS316-UAS(PGK1)-P$_{FBA1}$-GUS with primer oBP674 (SEQ ID NO: 162), containing an AscI restriction site, and primer oBP675 (SEQ ID NO: 163), containing a PmeI restriction site. The UAS(PGK1)-P$_{FBA1}$ PCR product was digested with AscI and PmeI and ligated with T4 DNA ligase into the corresponding sites of the plasmid containing kivD_LI(y)-ADH1 Fragments ABC to generate pBP1181.

Construction of pBP1716, pBP1719, and pBP2019 kivD_LI(y) was removed from the ADH1 deletion/UAS(PGK1)P[FBA1]-kivD_LI(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 210), containing a PmeI restriction site, and primer oBP484 (SEQ ID NO: 211), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_LI(y) was cloned into the resulting vector for the targeted deletion of kivD_LI(y) in PNY1528. The fragment was amplified from pBP1181 with primers oBP822 (SEQ ID NO: 212), containing a NotI restriction site, and oBP823 (SEQ ID NO: 213), containing a PacI restriction site. The fragment was digested with NotI and PacI and ligated with T4 DNA ligase into the corresponding sites downstream of URA3 in the above plasmid with the kivD_Ll(y) deletion after digestion with the appropriate restriction enzymes. The resulting plasmid was designated pBP1716.

The kivD coding region from *Listeria grayi* codon optimized for expression in *Saccharomyces cerevisiae* (SEQ ID NO: 214), kivD_Lg(y), was synthesized by DNA2.0 (Menlo Park, Calif.). kivD_Lg(y) was amplified with primers oBP828 (SEQ ID NO: 215), containing a PmeI restriction site, and oBP829 (SEQ ID NO: 216) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 217) and oBP829 (SEQ ID NO: 216). An isolate with kivD_Lg(y) in the correct orientation was designated pBP1719.

The kivD coding region from *Macrococcus caseolyticus* codon optimized for expression in *Saccharomyces cerevisiae* (SEQ ID NO: 224), kivD_Mc(y), was synthesized by DNA2.0 (Menlo Park, Calif.). kivD_Mc(y) was amplified with primers oBP900 (SEQ ID NO: 226), containing a PmeI restriction site, and oBP901 (SEQ ID NO: 227) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 217) and oBP901 (SEQ ID NO: 227). An isolate with kivD_Mc(y) in the correct orientation was designated pBP2019.

Construction of Strains PNY1549, PNY1550, and PNY1551

Strain PNY1528 was transformed with plasmids pLH702 and pYZ067ΔkivDΔhADH. A transformant was designated PNY1549.

The kivD_Ll(y) deletion/kivD_Lg(y) integration cassette was amplified from pBP1719 with primers oBP505 (SEQ ID NO: 73) and oBP823 (SEQ ID NO: 213). Competent cells of the PNY1528 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_Ll(y) and integration of kivD_Lg(y) was confirmed by PCR with primers oBP674 (SEQ ID NO: 162) and oBP830 (SEQ ID NO: 220) using genomic DNA prepared with a YeaStar Genomic DNA kit (Zymo Research). A correct isolate contained kivD_Lg(y) at the same locus and expressed from the same promoter as kivD_Ll(y) in PNY1528. An isolate was transformed with plasmids pLH702 and pYZ067ΔkivDΔhADH. A transformant was designated PNY1550.

The kivD_Ll(y) deletion/kivD_Mc(y) integration cassette was amplified from pBP2019 with primers oBP505 (SEQ ID NO: 157) and oBP823 (SEQ ID NO: 213). Competent cells of the PNY1528 were made and transformed with the PCR product using a Frozen-EZ Yeast Transformation II kit (Zymo Research). Transformation mixtures were plated on synthetic complete media lacking uracil supplemented with 1% ethanol at 30 C. Transformants were screened for by PCR with primers HY51 (SEQ ID NO: 221) and oBP906 (SEQ ID NO: 222). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_Ll(y) and integration of kivD_Mc(y) was confirmed by PCR with primers HY50 (SEQ ID NO: 223) and HY51 (SEQ ID NO: 221) using genomic DNA prepared with a YeaStar Genomic DNA kit (Zymo Research). A correct isolate contained kivD_Mc(y) at the same locus and expressed from the same promoter as kivD_Ll(y) in PNY1528. An isolate was transformed with plasmids pLH702 and pYZ067ΔkivDΔhADH. A transformant was designated PNY1551.

Example 12

KIVD Fermentations

Methods:
Inoculum Preparation

For each strain, a single frozen vial was thawed and transferred to 10 mL seed medium in a 125 mL vented shake flask, and incubated at 30° C. and 300 rpm shaking for overnight growth. Five mL of the overnight culture was then transferred to a 250 mL vented shake flask with 75 mL of the seed medium for overnight growth at 30° C. and 300 rpm shaking. When the culture reached OD600 1-2, the flask culture was used to inoculate the 1 L fermenter. The seed medium composition is as follows: yeast nitrogen base without amino acids (Difco), 6.7 g/L; Yeast Synthetic Drop-out Medium Supplements without histidine, leucine, tryptophan and uracil (Sigma), 2.8 g/L; L-leucine, 20 mg/L; L-tryptophan, 4 mg/L; Thiamine HCl, 20 mg/L; niacin, 20 mg/L; ethanol, 3 g/L; glucose 10 g/L. The pH was adjusted to 5.2 with 20% potassium hydroxide, and the medium filter sterilized through a 0.22µ filter.

Fermenter Preparation and Operation:

Fermentations were carded out in 1 L Biostat B DCU3 fermenters (Sartorius, USA). Off-gas composition was monitored by a Prima DB mass spectrometer (Thermo Electron Corp., USA). To measure the isobutanol and ethanol in the off-gas, the gas was first passed through a 1 liter Shott bottle with 0.5 L water, placed in an ice water bath, before sending to the mass spectrometer. The temperature of the fermenter was maintained at 30° C., and pH controlled at 5.2 with 20% KOH throughout the entire fermentation. Aeration was controlled at 0.2 standard liters per minute, and agitation controlled at 100 rpm. Dissolved oxygen was not controlled, and was non-detectable for most of the fermentation. Samples were drawn and analyzed for optical density at 600 nm and for glucose concentration by a YSI Select Biochemistry Analyzer (YSI, Inc., Yellow Springs, Ohio). Using this analysis, glucose was maintained in excess (5-20 g/L) by manual additions of a 50% (w/w) solution.

The medium used for the fermentations was prepared as follows: prior to sterilization, 520 mL water with 4.0 g ammonium sulfate, 2.2 g potassium phosphate monobasic, 1.5 g magnesium sulfate heptahydrate, and 0.2 mL Sigma Antifoam 204 was transferred to the fermenter. The fermenters were sterilized at 121° C. for 30 minutes. After cooling to the set point of 30° C., the post sterilization ingredients were added aeseptically via a pump. The post sterilization ingredients are made in 200 mL total volume: 4.8 mL of a trace mineral solution (prepared in 1 L water: 15 g EDTA, 4.5 g zinc sulfate heptahydrate, 0.8 g manganese chloride dehydrate, 0.3 g cobalt chloride hexahydrate, 0.3 g copper sulfate pentahydrate, 0.4 g disodium molybdenum dehydrate, 4.5 g calcium chloride dihydrate, 3 g iron sulfate heptahydrate, 1 g boric acid, 0.1 g potassium iodide), 0.8 mL of a vitamin mixture (in 1 L water, 50 mg biotin, 1 g Ca-pantothenate, 1 g nicotinic acid, 25 g myo-inositol, 1 g pyridoxol hydrochloride, 0.2 g p-aminobenzoic acid), 16 g glucose, 3 mL ethanol, 12.8 mg L-leucine, 3.2 mg L-tryptophan, 2.2 g Yeast Synthetic Drop-out Medium Supplements without histidine, leucine, tryptophan and uracil (Sigma), thiamine HCl was added in the amounts indicated in Table 1 for a specific fermentation, and deionized water to bring the volume to 200 mL; the solution was filter sterilized prior to addition to the fermenter. Final volume of the fermenter, post inoculation, was 800 mL.

Measurements of glucose, isobutanol, and other fermentation by-products in the culture supernatant were carried out by HPLC, using a Bio-Rad Aminex HPX-87H column (Bio-Rad, USA), with refractive index (RI) and a diode array (210 nm) detectors, with an Agilent 1100 series HPLC (Agilent, USA). Chromatographic separation was achieved using 0.01 N $H_2SO_4$ as the mobile phase with a flow rate of 0.6 mL/min and a column temperature of 40° C. The water trap was sampled at the end of the fermentation and analyzed by the same HPLC method. The weight of water in the trap was also measured to determine the total amount of isobutanol and ethanol stripped from the fermenter. The glucose concentration in the feed bottle was determined with a Mettler Toledo RE40 Refractometer (Mettler Toledo, USA) at 20° C. Reported yields are based on glucose consumed. The yield of isobutanol includes isobutanol in the fermentation broth and in the water trap at the last sample. FIG. 2 shows the molar yields of isobutanol and α-ketoisovalerate for each strain at each thiamine concentration. FIG. 3 shows the concentration of α-ketoisovalerate over the fermentation time for each strain at each thiamine concentration.

TABLE 13

Experimental design. All fermenters were prepared as described above, with the following thiamine additions, and strains used. Results are given for the end of fermentation sample, at 70-72 hours elapsed fermentation time.

| Experiment | Strain | KIVD Source organism | KIVD amino acid SEQ ID NO: | Thiamine-HCl (mg/L) | Yield of α-ketoisovalerate mol/mol) | Yield of isobutanol (mol/mol) |
|---|---|---|---|---|---|---|
| A | PNY1549 | Lactococcus lactis | 68 | 0 | 0.020 | 0.711 |
| B | PNY1549 | Lactococcus lactis | 68 | 1 | 0.018 | 0.719 |
| C | PNY1549 | Lactococcus lactis | 68 | 30 | 0.015 | 0.744 |
| D | PNY1550 | Listeria grayi | 52 | 0 | 0.008 | 0.725 |
| E | PNY1550 | Listeria grayi | 52 | 1 | 0.008 | 0.761 |
| F | PNY1550 | Listeria grayi | 52 | 30 | 0.009 | 0.761 |
| G | PNY1551 | Macrococcus caseolyticus | 61 | 0 | 0.013 | 0.742 |
| H | PNY1551 | Macrococcus caseolyticus | 61 | 1 | 0.012 | 0.731 |

TABLE Z

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4   -8455     -4   -8455     -4   -8455     -4
NULT      -4   -8455
NULE     595   -1558    85   -1000  -1000  -1000   -8455    -4   -8455    -4    -8455   -1085   -142    -21   -313    45    531    201    384   -1998   -644
HMM        A       C       D       E       F       G       H       I       K       L        M       N       P       Q       R       S       T       V       W       Y
         m->m    m->i    m->d    i->m    i->i    d->m    d->d    b->m    m->e
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 1 | -660 -149 -5 | -1258 -500 -8611 | -3102 233 -9654 | -2504 43 -894 | -1232 -381 -1115 | -2786 399 -701 | -1646 106 -1378 | -191 -626 -125 | -2212 210 * | 380 -466 | 4107 -720 | -1056 275 | 57 394 | -1939 45 | -2210 96 | 149 359 | 299 117 | -683 -369 | -1714 -294 | -1356 -249 | 24 |
| 2 | -333 -149 -52 | -2802 -500 -8855 | 232 233 -4910 | 188 43 -894 | -9 -381 -1115 | -2305 399 -701 | -964 106 -1378 | -2872 -626 * | 1309 210 * | -2817 -466 | 2554 -720 | -74 275 | -783 394 | 1796 45 | 162 96 | 606 359 | -870 117 | -2423 -369 | -2986 -294 | -2304 -249 | 25 |
| 3 | -167 -149 -3 | -3177 -500 -9373 | -897 233 -10416 | -224 43 -894 | -3496 -381 -1115 | -1807 399 -701 | -1342 106 -1738 | -3245 -626 * | 584 210 * | -3192 -466 | 3472 -720 | 487 275 | 495 394 | -43 45 | -1431 96 | 606 359 | 1206 117 | -2798 -369 | -3362 -294 | -2680 -249 | 26 |
| 4 | -1278 -149 -3 | -3309 -500 -9548 | -1010 233 -10590 | -634 43 -894 | -357 -381 -1115 | -406 399 -701 | -343 106 -1378 | -1699 -626 * | 1703 210 * | -3324 -466 | 1723 -720 | 790 275 | 529 394 | 1399 45 | -263 96 | -392 359 | 845 117 | -774 -369 | -3494 -294 | -2813 -249 | 27 |
| 5 | -2071 -149 -3 | -1909 -500 -9548 | -4335 233 -10590 | -3705 43 -894 | 319 -381 -1115 | -3610 399 -701 | -2474 106 -1378 | 685 -626 * | -1209 210 * | -1256 -466 | 1140 -720 | -3229 275 | -3660 394 | 1133 45 | -3145 96 | -2692 359 | -581 117 | -796 -369 | -2361 -294 | 3989 -249 | 28 |
| 6 | -2265 -149 -3 | 1438 -500 -9548 | -2171 233 -10590 | -294 43 -894 | -4000 -381 -1115 | -3199 399 -701 | -1756 106 -1378 | -3694 -626 * | 495 210 * | -3614 -466 | -2730 -720 | -1845 275 | -3276 394 | 109 45 | 1310 95 | -491 359 | 3142 117 | -3283 -369 | -3740 -294 | -3153 -249 | 29 |
| 7 | -3887 -149 -3 | -3370 -500 -9548 | -6589 233 -10590 | -6295 43 -894 | -4112 -381 -1115 | -6441 399 -701 | -6626 106 -1378 | 2521 -626 * | -6287 210 * | -2845 -466 | -2785 -720 | -6121 275 | -6182 394 | -6284 45 | -6491 96 | -5847 359 | -3884 117 | 3280 -369 | -5948 -294 | -5390 -249 | 30 |
| 8 | 1958 -149 -3 | -3190 -500 -9548 | -5727 233 -10590 | -6081 43 -894 | -5916 -381 -1115 | 3113 399 -701 | -5211 106 -1378 | -5746 -626 * | -5875 210 * | -6004 -466 | -5029 -720 | -4274 275 | -4282 394 | -5298 45 | -5507 95 | 271 359 | -3050 117 | -4411 -369 | -6133 -294 | -6113 -249 | 31 |
| 9 | -35 -149 -3 | 668 -500 -9548 | 2939 233 -10590 | 441 43 -894 | -3662 -381 -1115 | -2834 399 -701 | -158 106 -1378 | -3413 -626 * | -1085 210 * | -3358 -466 | -2433 -720 | -264 275 | -2932 394 | 1789 45 | -819 96 | -1749 359 | 462 117 | -2964 -369 | -3527 -294 | -2843 -249 | 32 |
| 10 | -6225 -149 -3 | -5134 -500 -9548 | -6587 233 -10590 | -6948 43 -894 | 1827 -381 -1115 | -6472 399 -701 | 895 106 -1378 | -5108 -626 * | -6502 210 * | -3671 -466 | -4508 -720 | -5078 275 | -6326 394 | -5219 45 | -5852 95 | -5721 359 | -6073 117 | -5255 -369 | -1896 -294 | 4623 -249 | 33 |
| 11 | -5223 -149 -3 | -4578 -500 -9548 | -7577 233 -10590 | -7024 43 -894 | -2613 -381 -1115 | -7388 399 -701 | -6057 106 -1378 | 687 -626 * | -6841 210 * | 3221 -466 | -1384 -720 | -7188 275 | -6354 394 | -5518 45 | -6276 96 | -6872 359 | -5060 117 | -2798 -369 | -4471 -294 | -4700 -249 | 34 |

TABLE Z-continued

```
HMMER2.0 [2.2 g]
NAME   sel_kivd
LENG   562
ALPH   Amino
RF     no
CS     no
MAP    yes
COM    hmmbuild -n sel_kivd sel_kivd.hmm sel_kivd.aln.fa
NSEQ   170
DATE   Wed Apr. 25 16:17:47 2012
CKSUM  3974
XT     -8455    -4    -8455  -1000  -1000  -8455   -4   -8455   -4
NULT   -4      -8455
NULE   595     -1558
HMM            A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -388 | -2357 | -4920 | -4290 | -8 | -4157 | -3025 | -90 | -3898 | 2720 | 1829 | -371 | -4150 | -3469 | -3685 | -3253 | -2508 | -142 | -2795 | -2502 | |
| 12 | -149 | -500 | 233 | 43 | -381 | 399 | 106 | -626 | 210 | -466 | -720 | 275 | 394 | 45 | 95 | 359 | 117 | -369 | -294 | -249 | 35 |
| | -3 | -9548 | -10590 | -894 | -1115 | -701 | -1378 | * | * | | | | | | | | | | | | |
| | -1312 | -3326 | 3471 | -1191 | -3636 | -2857 | -1516 | -3375 | -19 | -1137 | -652 | -483 | -2953 | 211 | -264 | -1773 | -304 | -2943 | -3512 | -2842 | |
| 13 | -149 | -500 | 233 | 43 | -381 | 399 | 106 | -626 | 210 | -466 | -720 | 275 | 394 | 45 | 96 | 359 | 117 | -369 | -294 | -249 | 36 |
| | -3 | -9548 | -10590 | -894 | -1115 | -701 | -1378 | * | * | | | | | | | | | | | | |
| | 439 | 482 | -5365 | -4228 | -5765 | -4150 | -3224 | -5238 | -1903 | -5063 | -4348 | -3769 | -4556 | -56 | 3921 | -3535 | -3562 | -4642 | -4970 | -4904 | |
| 14 | -149 | -500 | 233 | 43 | -381 | 399 | 106 | -626 | 210 | -466 | -720 | 275 | 394 | 45 | 96 | 359 | 117 | -369 | -294 | -249 | 37 |
| | -3 | -9548 | -10590 | -894 | -1115 | -701 | -1378 | * | * | | | | | | | | | | | | |
| | -4929 | -4319 | -7396 | -6867 | -2328 | -7246 | -6080 | 112 | -6718 | 3131 | -1465 | -6963 | -6308 | -5551 | -6263 | -6654 | -4800 | 475 | -4565 | -4762 | |
| 15 | -149 | -500 | 233 | 43 | -381 | 399 | 106 | -626 | 210 | -466 | -720 | 275 | 394 | 45 | 96 | 359 | 117 | -369 | -294 | -249 | 38 |
| | -3 | -9548 | -10590 | -894 | -1115 | -701 | -1378 | * | * | | | | | | | | | | | | |
| | 1907 | -3310 | -1691 | 14 | -3630 | -2817 | 2053 | -3379 | 934 | -3326 | -2400 | -34 | -2910 | 320 | -124 | 453 | 139 | -441 | -3495 | 183 | |
| 16 | -149 | -500 | 233 | 43 | -381 | 399 | 106 | -626 | 210 | -466 | -720 | 275 | 394 | 45 | 96 | 359 | 117 | -369 | -294 | -249 | 39 |
| | -3 | -9548 | -10590 | -894 | -1115 | -701 | -1378 | * | * | | | | | | | | | | | | |
| | -56 | -3334 | 628 | 2641 | -3654 | -331 | -1491 | -3405 | -1074 | -3350 | -2424 | -817 | -2924 | 2132 | -402 | -1266 | -803 | -1684 | -3517 | -2834 | |
| 17 | -149 | -500 | 233 | 43 | -381 | 399 | 106 | -626 | 210 | -466 | -720 | 275 | 394 | 45 | 96 | 359 | 117 | -369 | -294 | -249 | 40 |
| | -3 | -9548 | -10590 | -894 | -1115 | -701 | -1378 | * | * | | | | | | | | | | | | |
| | 1279 | 2713 | -4407 | -3772 | -1845 | -3612 | -2483 | 1586 | -3367 | 1485 | 641 | -1380 | -3662 | -2991 | -3168 | -2406 | -1248 | 668 | -2349 | -339 | |
| 18 | -149 | -500 | 233 | 43 | -381 | 399 | 106 | -626 | 210 | -466 | -720 | 275 | 394 | 45 | 96 | 359 | 117 | -369 | -294 | -249 | 41 |
| | -3 | -9548 | -10590 | -894 | -1115 | -701 | -1378 | * | * | | | | | | | | | | | | |
| | -3670 | -4955 | -1906 | -1907 | -6132 | 3635 | -139 | -6124 | -3779 | -6037 | -5399 | 204 | -4392 | -3184 | -4528 | -2134 | -3907 | -5347 | -6174 | -5241 | |
| 19 | -149 | -500 | 233 | 43 | -381 | 399 | 106 | -626 | 210 | -466 | -720 | 275 | 394 | 45 | 96 | 359 | 117 | -369 | -294 | -249 | 42 |
| | -3 | -9548 | -10590 | -894 | -1115 | -701 | -1378 | * | * | | | | | | | | | | | | |
| | 127 | 888 | -6505 | -6193 | -4072 | -6225 | -6315 | 3224 | -6149 | -2864 | -6048 | -5955 | -6048 | -6110 | -6308 | -5592 | -3804 | 2290 | -5770 | -5233 | |
| 20 | -149 | -500 | 233 | 43 | -381 | 399 | 106 | -626 | 210 | -466 | -720 | 275 | 394 | 45 | 96 | 359 | 117 | -369 | -294 | -249 | 43 |
| | -3 | -9548 | -10590 | -894 | -1115 | -701 | -1378 | * | * | | | | | | | | | | | | |
| | -1404 | -3317 | 1934 | 1446 | -3638 | -534 | 514 | -3388 | 708 | -3333 | -2406 | -842 | -2910 | 484 | 1364 | 238 | 397 | -2939 | -3500 | -2817 | |
| 21 | -149 | -500 | 233 | 43 | -381 | 399 | 106 | -626 | 210 | -466 | -720 | 275 | 394 | 45 | 96 | 359 | 117 | -369 | -294 | -249 | 44 |
| | -3 | -9548 | -10590 | -894 | -1115 | -701 | -1378 | * | * | | | | | | | | | | | | |
| | -3542 | -4840 | -959 | 1493 | -5356 | -3960 | 4527 | -4961 | 1266 | -4736 | -3985 | -2578 | -4184 | -2160 | 621 | -3339 | -3428 | -4588 | -4729 | -4266 | |
| 22 | -149 | -500 | 233 | 43 | -381 | 399 | 106 | -626 | 210 | -466 | -720 | 275 | 394 | 45 | 96 | 359 | 117 | -369 | -294 | -249 | 45 |
| | -3 | -9548 | -10590 | -894 | -1115 | -701 | -1378 | * | * | | | | | | | | | | | | |
| | -4614 | -4064 | -7106 | -6593 | -949 | -6859 | -5831 | 2651 | -6423 | 2041 | 887 | -6551 | -6148 | -5470 | -6075 | -6196 | -4514 | 1432 | -4557 | -4662 | |
| 23 | -149 | -500 | 233 | 43 | -381 | 399 | 106 | -626 | 210 | -466 | -720 | 275 | 394 | 45 | 96 | 359 | 117 | -369 | -294 | -249 | 46 |
| | -3 | -9548 | -10590 | -894 | -1115 | -701 | -1378 | * | * | | | | | | | | | | | | |
| 24 | -6152 | -5102 | -6594 | -6934 | 4451 | -6466 | -2681 | -923 | -6494 | -4175 | -4291 | -5098 | -6314 | -5222 | -5861 | -5720 | -6008 | -5089 | -1926 | 728 | 47 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4
NULT     -4  -8455
NULE    595 -1558   85   338  -294  -1000   453    -4  -1158    -4   197   249   902  -1085  -142   -21  -313    45   531   201   384 -1998  -644
HMM       A     C    D     E     F     G     H     I     K     L     M     N     P     Q     R     S     T     V     W     Y
              -149  -500  233    43  -381   399   106  -626   210  -466  -720   275   394    45    96   359   117  -369  -294  -249
25    -6817 -6056 -7068 -7452 -7681  3860 -6790 -8639 -7676 -8090 -7933 -7257 -6558 -7506 -7149 -7192 -7136 -8044 -6471 -7683    48
              -149  -500  -10590 -894 -1115  -701  -1378 -626    210  -466  -720   275   394    45    96   359   117  -369  -294  -249
                -3 -9548
26    -3890 -3451 -6562 -6315 -3054 -6092 -6094  -762 -6251 -2744 -2730 -5971 -6030 -6109 -6344 -5501 -3925  3824 -5423 -4771    49
              -149  -500 -10590 -894 -1115  -701   106  -626   210  -466  -720   275   394    45    96   359   117  -369  -294  -249
                -3 -9548
27    -1434 -4223 -5963 -6324 -6579 -4430 -5795 -6684 -6416 -6779 -6008 -5195 -4270 -6007 -6104 -4012 -4219 -5504 -6773 -6647    50
              -149  -500   233    43  -381   399   106  -626   210  -466  -720   275   394    45    96   359   117  -369  -294  -249
                -3 -9548
28    -6817 -6056 -7068 -7452 -7681  3860 -6790 -8639 -7676 -8090 -7933 -7257 -6558 -7506 -7149 -7192 -7136 -8044 -6471 -7683    51
              -149  -500 -10590 -894 -1115  -701   106  -626   210  -466  -720   275   394    45    96   359   117  -369  -294  -249
                -3 -9548
29    -7011 -6304  4224 -5696 -7592 -5938 -6173 -8539 -6895 -7973 -7843 -5989 -6423 -6412 -6926 -7057 -7168 -8129 -6463 -7354    52
              -149  -500 -10590 -894 -1115  -701   106  -626   210  -466  -720   275   394    45    96   359   117  -369  -294  -249
                -3 -9548
30    -6231 -5144 -6594 -6955  3179 -6466 -2671 -5120 -6516 -4420 -4520 -5096 -6329 -5237 -5876 -5736 -6083 -5279 -1917  4241    53
              -149  -500 -10590 -894 -1115  -701   106  -626   210  -466  -720   275   394    45    96   359   117  -369  -294  -249
                -3 -9548
31    -3089 -3913 -2711 -3071 -5966 -3634 -3928 -5661 -4075 -5921 -5129 -4262 -4340 -1432 -4466 -1393  -511 -4824 -1917 -5471    54
              -149  -500 -10590 -894 -1115  -701   106  -626   210  -466  -720   275   394    45    96   359   117  -369  -294  -249
                -3 -9548
32    -5317 -4663 -7620 -7063 -2591 -7400 -6033 -2118 -6856  3317   350 -7238 -6360 -5504 -6263 -6915 -5143 -3017 -4443 -4675    55
              -149  -500 -10590 -894 -1115  -701   106  -626   210  -466  -720   275   394    45    96   359   117  -369  -294  -249
                -3 -9548
33     1427 -3312 -1690   714 -3632  -653  1142 -3382  -396 -2032 -2401 -1452 -2909  2371    93   886    49 -2933 -3496 -1434    56
              -149  -500 -10590 -894 -1115  -701   106  -626   210  -466  -720   275   394    45    96   359   117  -369  -294  -249
                -3 -9548
34    -6164 -5107 -6607 -6943 -6485 -6485 -2694 -4807 -6504  -663 -4182 -5113 -6320 -5226 -5869 -5739 -6014 -5084 -1937   772    57
              -149  -500 -10590 -894 -1115  -701   106  -626   210  -466  -720   275   394    45    96   359   117  -369  -294  -249
                -3 -9548
35    -6540 -5651 -7264 -7405 -4412 -6422 -6465 -4083 -7402  3396 -3353 -7378 -6583 -6726 -6858 -7527 -6525 -4898 -5545 -5865    58
              -149  -500 -10591 -894 -1115  -701   106  -626   210  -466  -720   275   394    45    96   359   117  -369  -294  -249
                -3 -9548
36    -4365 -6260  3945  1169 -6500 -4023 -3531 -6583 -4015 -6379 -5878 -2648 -4625 -3243 -5050 -3962 -4480 -6011 -6405 -5420    59
              -149  -500   233    43  -381   399   106  -626   210  -466  -720   275   394    45    96   359   117  -369  -294  -249
```

| HMMER2.0 [2.2 g] | | | | | | | | | | | | | | | | | | | | | |
|---|---|---|---|---|---|---|---|---|---|---|---|---|---|---|---|---|---|---|---|---|---|
| NAME | sel_kivd | | | | | | | | | | | | | | | | | | | | |
| LENG | 562 | | | | | | | | | | | | | | | | | | | | |
| ALPH | Amino | | | | | | | | | | | | | | | | | | | | |
| RF | no | | | | | | | | | | | | | | | | | | | | |
| CS | no | | | | | | | | | | | | | | | | | | | | |
| MAP | yes | | | | | | | | | | | | | | | | | | | | |
| COM | hmmbuild -n sel_kivd sel_kivd.hmm sel_kivd.aln.fa | | | | | | | | | | | | | | | | | | | | |
| NSEQ | 170 | | | | | | | | | | | | | | | | | | | | |
| DATE | Wed Apr. 25 16:17:47 2012 | | | | | | | | | | | | | | | | | | | | |
| CKSUM | 3974 | | | | | | | | | | | | | | | | | | | | |
| XT | -8455 | -4 | -8455 | -4 | -1000 | -1000 | -8455 | -4 | -8455 | -4 | | | | | | | | | | | |
| NULT | -4 | -8455 | | | | | | | | | | | | | | | | | | | |
| NULE | 595 | -1558 | 85 | 338 | -294 | 453 | -1158 | 197 | 249 | 902 | -1085 | -142 | -21 | -313 | 45 | 531 | 201 | 384 | -1998 | -644 | |
| HMM | A | C | D | E | F | G | H | I | K | L | M | N | P | Q | R | S | T | V | W | Y | |
| | — | — | — | — | — | — | — | — | — | — | — | — | — | — | — | — | — | — | — | — | |
| 37 | -1877 | -3344 | -10591 | -894 | -1115 | -701 | -1378 | * | -1090 | -827 | -2435 | 351 | -2939 | 1585 | 132 | -849 | -1816 | -2964 | -3528 | 1209 | 60 |
| | -149 | -500 | 1806 | -647 | -3661 | -2840 | 3577 | -3410 | 210 | -466 | -720 | 275 | 394 | 45 | 96 | 359 | 117 | -369 | -294 | -249 | |
| | -3 | -9548 | 233 | -894 | -381 | 399 | 106 | -626 | | | | | | | | | | | | | |
| 38 | -3888 | -3371 | -6591 | -6296 | -4112 | -6445 | -6628 | 3014 | -6288 | -2845 | -2784 | -6123 | -6184 | -6285 | -6492 | -5851 | -3885 | 2938 | -5949 | -5392 | 61 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 39 | -2036 | -2027 | -1692 | 858 | -2001 | -3476 | -311 | 2907 | -2736 | -1142 | 1071 | -2830 | -3535 | -23 | -2811 | -2520 | -920 | 1393 | -2470 | -2102 | 62 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 40 | 1971 | -3329 | 1578 | 244 | -3649 | -1476 | 620 | -3400 | -1068 | -3345 | -2418 | 192 | -2919 | -154 | -8 | 1202 | -783 | -2951 | -3512 | -2828 | 63 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 41 | -409 | -3453 | 622 | -1232 | -3765 | -2911 | 4439 | -3515 | -1201 | -3464 | -2549 | 262 | -3029 | -602 | 89 | 569 | -1928 | -3072 | -3637 | -773 | 64 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 42 | -1972 | -3458 | 1098 | 1443 | -3775 | -1962 | -1591 | -3530 | 741 | -3742 | -2551 | 712 | 2774 | -1136 | -528 | -590 | -1333 | -3078 | -3640 | -2948 | 65 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 43 | -400 | -3315 | 1794 | 438 | -3636 | 920 | 501 | -2681 | 830 | -3331 | -2404 | 781 | -2909 | 1025 | 464 | -535 | -257 | -794 | -3498 | -2816 | 66 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 44 | -4352 | -3807 | -6941 | -6518 | -3113 | -6765 | -6118 | 2949 | -6417 | 1584 | 1690 | -6443 | -6191 | -5726 | -6244 | -6138 | -4293 | 1471 | -4920 | -4907 | 67 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 45 | -798 | 1286 | 168 | 2104 | -3636 | -1010 | 35 | -3386 | 851 | -3331 | -2404 | -1451 | -2909 | 615 | 1532 | -538 | 570 | -1537 | -3498 | -2815 | 68 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 46 | -6146 | -5110 | -6626 | -6951 | 1846 | -6478 | -2744 | -4716 | -6512 | -1758 | -4082 | -5152 | -6322 | -5252 | -5883 | -5764 | -6004 | -5036 | 5977 | -802 | 69 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 47 | -3594 | -3158 | -6187 | -5771 | -3651 | -5815 | -5287 | 2351 | -5594 | -2650 | 689 | -5470 | -5666 | -874 | -5607 | -5074 | -1307 | 3167 | -4922 | -4493 | 70 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |
| 48 | -5086 | -5209 | -6442 | -6820 | -7267 | 3818 | -6361 | -7746 | -7109 | -7562 | -7035 | -6182 | -1070 | -6779 | -6728 | -5360 | -5517 | -6730 | -6416 | -7292 | 71 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | * | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455  -4    -1000  -1000  -8455  -4    -8455  -4
NULT  -4     -8455
NULE  595    -1558
HMM          A      C      D      E      F      G      H      I      K      L      M      N      P      Q      R      S      T      V      W      Y
             -149   -500   233    43     -381   399    106    -626   210    -466   -720   275    394    45     96     359    117    -369   -294   -249
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 49 | -873 | 4117 | -5719 | -5958 | -5804 | -1912 | -5112 | -5610 | -5689 | -5869 | -4911 | 3400 | -4262 | -5173 | -5390 | -561 | 826 | -4348 | -6030 | -5975 | 72 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 50 | 2569 | 4099 | -5963 | -6297 | -5860 | -3458 | -5528 | -5665 | -5907 | -5938 | -4972 | -4302 | -4725 | -5336 | -5503 | -1218 | 1837 | -4368 | -6091 | -6072 | 73 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 51 | -6525 | -6005 | -6086 | -6469 | -7264 | -5910 | -6392 | -8381 | -7104 | -7895 | -7691 | -4452 | -6421 | -6848 | -6867 | -6767 | -6826 | -7793 | -6362 | -7082 | 74 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 52 | -7062 | -6299 | -5429 | 3971 | -7596 | -5972 | -6218 | -8532 | -6862 | -7964 | -7840 | -6101 | -6450 | -6478 | -6844 | -7139 | -7217 | -8138 | -6457 | -7375 | 75 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 53 | -6540 | -5651 | -7264 | -7405 | -4412 | -6422 | -6465 | -4083 | -7402 | 3396 | -3353 | -7378 | -6583 | -6726 | -6858 | -7527 | -6525 | -4898 | -5545 | -5865 | 76 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 54 | -6525 | -6005 | -6086 | -6469 | -7264 | -5910 | -6392 | -8381 | -7104 | -7895 | -7691 | -4452 | -6421 | -6848 | -6867 | -6767 | -6823 | -7793 | -6362 | -7082 | 77 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 55 | 3618 | -3587 | -5871 | -6231 | -6208 | -629 | -5473 | -6122 | -6137 | -6333 | -5418 | -4647 | -4637 | -5610 | -5778 | -3275 | -3495 | -4828 | -6207 | -6366 | 78 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 56 | 2729 | -3187 | -5769 | -6118 | -5914 | 1544 | -5216 | -5742 | -5881 | -6001 | -5025 | -4279 | -4281 | -5305 | -5507 | 1916 | -3057 | -4407 | -6131 | -6113 | 79 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 57 | -7113 | -5912 | -6980 | -7350 | -3209 | -6288 | -4498 | -6840 | -7294 | -6152 | -6227 | -6478 | -6594 | -6601 | -6729 | -7077 | -7152 | -6886 | -3797 | 4945 | 80 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 58 | 3583 | -3173 | -5811 | -6117 | -5746 | -3469 | -5158 | -5452 | -5764 | -5769 | 390 | -4277 | -4278 | -5255 | -5410 | -2336 | -1310 | -4290 | -6008 | -5951 | 81 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 59 | 3647 | -3308 | -5792 | -6140 | -5960 | -3582 | -5280 | -5762 | -5907 | -6047 | -5117 | -4389 | -4391 | -5382 | -5549 | -2967 | -1522 | -4468 | -6131 | -6139 | 82 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 60 | -7012 | -6305 | 4224 | -5697 | -7593 | -5939 | -6174 | -8540 | -6896 | -7973 | -7844 | -5991 | -6424 | -6413 | -6927 | -7058 | -7169 | -8130 | -6464 | -7355 | 83 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9548 | -10591 | -894 | -1115 | -701 | -1378 | * | * | * | * | | | | | | | | | | |
| 61 | -6818 | -6056 | -7069 | -7453 | -7681 | 3860 | -6791 | -8640 | -7677 | -8091 | -7934 | -7257 | -6559 | -7507 | -7150 | -7193 | -7137 | -8045 | -6472 | -7684 | 84 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4   -8455     -4   -8455     -4
NULT      -4   -8455
NULE     595   -1558  -1000  -1000   -294     -4  -8455     -4    -1085   -142    -21    -313     45     531     201     384   -1998   -644
HMM        A       C       D       E      F       G       H       I       K      L      M       N       P       Q       R       S       T       V       W       Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 62 | -7113 | -5912 | -6980 | -7350 | -3209 | -6288 | -4498 | -6840 | -7294 | -6152 | -6227 | -6478 | -6594 | -6601 | -6729 | -7077 | -7152 | -6886 | -3797 | 4945 | 85 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 63 | 3488 | -3199 | -5761 | -6113 | -5920 | 589 | -5221 | -5743 | -5879 | -6006 | -5034 | -4289 | -4292 | -5311 | -5507 | -2846 | -1572 | -4416 | -6132 | -6117 | 86 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 64 | -7254 | -6210 | -7079 | -7064 | -7531 | -6170 | -6202 | -8372 | -5727 | -7773 | -7566 | -6974 | -6572 | -6416 | 4266 | -7571 | -7309 | -8053 | -6330 | -7278 | 87 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 65 | -2092 | 3243 | -4408 | -242 | -1875 | -3641 | -2513 | 1735 | -3379 | 1156 | 1769 | -3277 | -3690 | 480 | -3191 | -2726 | 221 | 640 | -2386 | -2043 | 88 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 66 | -1017 | -3538 | -2023 | -1440 | -3896 | -3082 | -1668 | -3610 | 1975 | -3534 | 818 | 2213 | -3163 | -648 | 2437 | -209 | -1250 | -3184 | -3669 | -3052 | 89 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 67 | -3632 | -4304 | -3901 | -3727 | -6082 | 3463 | -3420 | -5645 | -504 | -5431 | -4731 | -3605 | 1433 | -3068 | -953 | -3702 | -3806 | -4993 | -5286 | -5166 | 90 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 68 | 1878 | -2573 | -5199 | -4591 | 1602 | -4478 | -3386 | 1888 | -4221 | 591 | 2136 | -4127 | -4446 | -3799 | -4021 | -3589 | -2567 | 533 | -3129 | -2836 | 91 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 69 | 2465 | -3188 | -5757 | -6108 | -5915 | 2455 | -5215 | -5743 | -5880 | -6002 | -5026 | -4278 | -4281 | -5303 | -5508 | 1322 | -3057 | -4408 | -6132 | -6114 | 92 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 70 | 3539 | 836 | -5969 | -6272 | -5670 | -3498 | -5219 | -4716 | -5882 | -5552 | -4751 | -4328 | -4304 | -5332 | -5494 | -2861 | -2400 | -435 | -6008 | -5947 | 93 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9548 | -10591 | -894 | -1115 | -701 | -1378 | -626 | * | -466 | -720 | 275 | 394 | 45 | 96 | 359 | 117 | -369 | -294 | -249 | |
| 71 | -5083 | -4473 | -7465 | -6867 | 800 | -7242 | -5870 | -194 | -6663 | 2814 | 2264 | -6966 | -6252 | -5400 | -6127 | -6607 | -4918 | 560 | -4390 | -4621 | 94 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | -626 | * | -466 | -720 | 275 | 394 | 45 | 96 | 359 | 117 | -369 | -294 | -249 | |
| 72 | -213 | 298 | -4956 | -4361 | -2405 | -4220 | -3179 | 1353 | -3994 | 2042 | -1568 | -3875 | -4245 | -3643 | -3823 | -1825 | -1647 | 2175 | -3022 | -2668 | 95 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | -626 | * | -466 | -720 | 275 | 394 | 45 | 96 | 359 | 117 | -369 | -294 | -249 | |
| 73 | -2613 | -3215 | -5612 | -5924 | -5633 | -3501 | -5118 | -2402 | -5643 | -5748 | -4895 | -4266 | -4307 | -5202 | -5341 | -1256 | 4001 | -4262 | -5980 | -5840 | 96 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | -626 | * | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| XT | -8455 | -4 | -1000 | -1000 | -8455 | -4 | -8455 | -4 | | | | | | | | | | | | | |
| NULT | -4 | -8455 | | | | | | | | | | | | | | | | | | | |
| NULE | 595 | -1558 | 85 | 338 | -294 | 453 | 1158 | 197 | 249 | 902 | -1085 | -142 | -21 | -313 | 45 | 531 | 201 | 384 | -1998 | -644 | |
| HMM | A | C | D | E | F | G | H | I | K | L | M | N | P | Q | R | S | T | V | W | Y | |
| 74 | -5076 | -5190 | -10592 | -7054 | -7082 | -5329 | -6374 | -7534 | * | -7413 | -6937 | -6271 | -5965 | -6844 | -6683 | -5360 | 4103 | -6627 | 6359 | -7090 | 97 |
|    | -149 | -500 | 233 | -894 | -381 | 399 | 106 | -626 | -7100 | -466 | -720 | 275 | 394 | 45 | 96 | 359 | 117 | -369 | -294 | -249 | |
|    | -3 | -9550 | -10592 | -894 | -1115 | -701 | -1378 | -626 | 210 | | | | | | | | | | | | |
| 75 | -1822 | -315 | -6206 | -6197 | -4127 | -5645 | -2721 | -3887 | -5776 | -3780 | -3584 | -4797 | -5691 | -4857 | -5329 | -4859 | -4691 | -1102 | -2021 | -2562 | 98 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 76 | -6820 | -6058 | -7070 | -7454 | -7683 | 3860 | -6795 | -8642 | -7678 | -8092 | -7936 | -7259 | -6560 | -7508 | -7152 | -7196 | -7139 | -8047 | -6473 | -7685 | 99 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 77 | -5460 | -5067 | -6930 | -7153 | -5975 | -5869 | -6541 | -3514 | -7191 | -5258 | -5195 | -6738 | -6319 | -7040 | -6859 | -6252 | -5668 | 3911 | -6198 | -6486 | 100 |
|    | -149 | -500 | 233 | -894 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 78 | -6820 | -6058 | -7070 | -7454 | -7683 | 6860 | -6792 | -8642 | -7678 | -8092 | -7936 | -7259 | -6560 | -7508 | -7152 | -7196 | -7139 | -8047 | -6473 | -7685 | 101 |
|    | -149 | -500 | 233 | -894 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 79 | -4115 | -6183 | 1150 | 3685 | -6340 | -3819 | -3304 | -6363 | -3776 | -6182 | -5653 | -2409 | -4425 | -3004 | -4836 | -1417 | -4232 | -5776 | -6380 | -5215 | 102 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 80 | -6542 | -5652 | -7265 | -7406 | -4414 | -6423 | -6466 | -4085 | -7403 | 3396 | -3355 | -7379 | -6584 | -6727 | -6859 | -7529 | -6527 | -4900 | -5547 | -5867 | 103 |
|    | -149 | -500 | 233 | -894 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 81 | -270 | -3200 | -5676 | -6032 | -5921 | -1624 | -5205 | -5753 | -5862 | -6010 | -5037 | -4271 | -4288 | -5289 | -5504 | 3620 | -3068 | -4419 | -6135 | -6112 | 104 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 82 | 3657 | -3391 | -5891 | -6230 | -5863 | -3674 | -5330 | -5497 | -5964 | -5893 | -5090 | -4486 | -4476 | -5459 | -5604 | -3070 | -3284 | -2572 | -6075 | -6040 | 105 |
|    | -149 | -500 | 233 | -894 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 83 | -148 | -3026 | -5947 | -5468 | -3299 | -5459 | -4693 | 3121 | -5229 | 813 | 693 | -5109 | -5348 | -4949 | -5158 | -4660 | -1460 | 1518 | -4376 | -4004 | 106 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 84 | -2880 | -3576 | -3507 | -3897 | -5991 | -864 | -4514 | -5910 | -4994 | -6071 | -5192 | 4277 | -4364 | -4386 | -5232 | -763 | -3320 | -4688 | -6147 | -5811 | 107 |
|    | -149 | -500 | 233 | -894 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |
| 85 | 1559 | -3594 | -5810 | -6173 | -6213 | 3451 | -5464 | -6130 | -6126 | -6338 | -5423 | -4637 | -4640 | -5595 | -5777 | -3279 | -3500 | -4835 | -6211 | -6367 | 108 |
|    | -149 | -500 | 233 | 43 | -381 | 399 | 106 | -626 | 210 | -466 | -720 | 275 | 394 | 45 | 96 | 359 | 117 | -369 | -294 | -249 | |
|    | -3 | -9550 | -10592 | -894 | -1115 | -701 | -1378 | -626 | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
```

| | A | C | D | E | F | G | H | I | K | L | M | N | P | Q | R | S | T | V | W | Y |
|---|---|---|---|---|---|---|---|---|---|---|---|---|---|---|---|---|---|---|---|---|
XT | -8455 | -4 | -1000 | -1000 | -8455 | -4 | -8455 | -4 | | | | | | | | | | | | |
NULT | -4 | -8455 | | | | | | | | | | | | | | | | | | |
NULE | 595 | -1558 | 85 | 338 | -294 | 453 | -1158 | 197 | 249 | 902 | -1085 | -142 | -21 | -313 | 45 | 531 | 201 | 384 | -1998 | -644 |
HMM | A | C | D | E | F | G | H | I | K | L | M | N | P | Q | R | S | T | V | W | Y |

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 86 | -3812 | -3333 | -6439 | -6052 | -3639 | -6164 | -5755 | 3517 | -5936 | -340 | 273 | -5819 | -5913 | -5703 | -5964 | -5470 | 652 | 1003 | -5167 | -4802 | 109 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 87 | 3609 | -3204 | -5772 | -6123 | -5921 | -1837 | -5225 | -5741 | -5878 | -6007 | -5037 | -4294 | -4296 | -5316 | -5507 | -2851 | -989 | -4418 | -6132 | -6118 | 110 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 88 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 111 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 89 | 1517 | -3229 | -5727 | -6079 | -5923 | -3503 | -5226 | -5770 | -5875 | -6027 | -5062 | -4306 | -4317 | -5318 | -5515 | 3379 | -3101 | -4447 | -6127 | -6104 | 112 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 90 | -6077 | -5086 | -6532 | -6846 | 2340 | -6389 | -2658 | -5069 | -6303 | -4398 | -4476 | -5051 | -6275 | -5173 | -822 | -2095 | -5956 | -5209 | -1911 | 4499 | 113 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 91 | 3609 | -3185 | -5808 | -6157 | -5905 | -3465 | -5219 | -5724 | -5874 | -5992 | -5019 | -4286 | -4281 | -5312 | -5496 | -1323 | -1317 | -4399 | -6126 | -6106 | 114 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 92 | -7065 | -6301 | -5432 | 3971 | -7597 | -5973 | -6220 | -8534 | -6864 | -7966 | -7842 | -6103 | -6452 | -6480 | -6846 | -7141 | -7219 | -8140 | -6459 | -7376 | 115 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 93 | -1143 | -142 | -1816 | -1265 | -1849 | -2885 | 2566 | -3075 | -1162 | -3119 | -2250 | 2224 | -2976 | 549 | 1284 | 22 | -1816 | -2718 | -3363 | 2668 | 116 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 94 | -778 | -3088 | -6056 | -5615 | -3487 | -5557 | -4961 | 224 | -5405 | 1064 | -2368 | -5256 | -5471 | -5166 | -5368 | -2258 | -3463 | 3318 | -4638 | -4240 | 117 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 95 | -7208 | -6181 | -7133 | -7515 | -7691 | -6164 | -6829 | -8742 | -7718 | -8131 | -8044 | -7415 | 4335 | -7586 | -7182 | -7628 | -7478 | -8268 | -6469 | -7677 | 118 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 96 | -3985 | -3461 | -6668 | -6345 | -3798 | -6525 | -6482 | -8742 | -6314 | -256 | -2502 | -6194 | -6189 | -6129 | -6427 | -5920 | -3970 | 3690 | -5621 | -5243 | 119 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 97 | -3991 | -3463 | -6674 | -6347 | -3792 | -6546 | -6497 | 3037 | -6321 | 949 | -2491 | -6205 | -6196 | -6129 | -6433 | -5941 | -3974 | 2315 | -5624 | -5261 | 120 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 98 | 596 | 820 | -1982 | -395 | -3866 | -3091 | 4492 | -3576 | 1175 | -3535 | -2649 | -1753 | -3199 | -622 | -1621 | -809 | -2098 | -3166 | -3702 | -3080 | 121 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -1000  -1000  -8455    -4  -8455    -4
NULT     -4  -8455
NULE    595  -1558
HMM       A      C      D      E      F      G      H      I      K      L      M      N      P      Q      R      S      T      V      W      Y
       -8455     -4  -1000  -1000  -8455     -4  -8455     -4  -1085   902    249    197   -142    -21   -313     45    531    201    384  -1998   -644
            -3  -9550                    -1115   -701  -1378   -626              210   -466   -720    275    394     45     96    359    117   -369   -294   -249
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 99 | -149 | -500 | 233 | 43 | -381 | 399 | 106 | -626 | 210 | -466 | -720 | 275 | 394 | 45 | 96 | 359 | 117 | -369 | -294 | -249 | |
| | -4049 | -9550 | -10592 | -894 | -1115 | -701 | -1378 | * | * | -540 | -2381 | -6253 | -6204 | -6079 | -6422 | -5980 | -4029 | 80 | -5503 | -5203 | 122 |
| | -3 | -3520 | -6722 | -6389 | -3668 | -6582 | -6459 | 3877 | -6352 | -466 | -720 | 275 | 394 | 45 | 96 | 359 | 117 | -369 | -294 | -249 | |
| | -149 | -500 | 233 | 43 | -381 | 399 | 106 | -626 | 210 | | | | | | | | | | | | |
| 100 | -3 | -9550 | -10592 | -894 | -1115 | -701 | -1378 | * | * | | | | | | | | | | | | |
| | 494 | -2807 | -5440 | -5132 | -3532 | -3878 | -4109 | -567 | -4797 | -3159 | -2645 | -4193 | -4378 | -4426 | -4618 | 435 | 2115 | 2834 | -4160 | -3834 | 123 |
| | -149 | -500 | 233 | 43 | -381 | 399 | 106 | -626 | 210 | -466 | -720 | 275 | 394 | 45 | 96 | 359 | 117 | -369 | -294 | -249 | |
| 101 | -3 | -9550 | -10592 | -894 | -1115 | -701 | -1378 | * | * | | | | | | | | | | | | |
| | -1391 | -3263 | -5642 | -5995 | -5919 | 3758 | -5222 | -5713 | -5850 | -6009 | -5071 | -4317 | -4344 | -5310 | -5512 | -2913 | -3136 | -2419 | -6119 | -6090 | 124 |
| | -149 | -500 | 233 | 43 | -381 | 399 | 106 | -626 | 210 | -466 | -720 | 275 | 394 | 45 | 96 | 359 | 117 | -369 | -294 | -249 | |
| 102 | -3 | -9550 | -10592 | -894 | -1115 | -701 | -1378 | * | * | | | | | | | | | | | | |
| | 2733 | -2273 | -4434 | -3909 | -2485 | -356 | -2923 | 92 | -3584 | -2375 | 114 | -3392 | -3815 | -3262 | -3500 | 96 | 1614 | -788 | -2968 | -2627 | 125 |
| | -149 | -500 | 233 | 43 | -381 | 399 | 106 | -626 | 210 | -466 | -720 | 275 | 394 | 45 | 96 | 359 | 117 | -369 | -294 | -249 | |
| 103 | -3 | -9550 | -10592 | -894 | -1115 | -701 | -1378 | * | * | | | | | | | | | | | | |
| | -1857 | -3322 | -5407 | -5758 | -5957 | -3576 | -5181 | -5791 | -5725 | -6045 | -5116 | -4303 | 4240 | -5243 | -5450 | -2966 | -1879 | -4516 | -6124 | -6097 | 126 |
| | -149 | -500 | 233 | 43 | -381 | 399 | 106 | -626 | 210 | -466 | -720 | 275 | 394 | 45 | 96 | 359 | 117 | -369 | -294 | -249 | |
| 104 | -3 | -9550 | -10592 | -894 | -1115 | -701 | -1378 | * | * | | | | | | | | | | | | |
| | 739 | 2166 | -3053 | -2548 | -3830 | -1155 | -2652 | -3482 | -2430 | -3664 | -2855 | -1084 | 1826 | -2337 | -974 | 1706 | 1974 | -1611 | -4015 | -3529 | 127 |
| | -149 | -500 | 233 | 43 | -381 | 399 | 106 | -626 | 210 | -466 | -720 | 275 | 394 | 45 | 96 | 359 | 117 | -369 | -294 | -249 | |
| 105 | -3 | -9550 | -10592 | -894 | -1115 | -701 | -1378 | * | * | | | | | | | | | | | | |
| | -584 | -1210 | -1961 | -1408 | -3094 | -2951 | -1630 | -2744 | 835 | 1117 | 552 | -1676 | -3038 | 1043 | 1139 | 627 | 1691 | -2464 | -3207 | -2635 | 128 |
| | -149 | -500 | 233 | 43 | -381 | 399 | 106 | -626 | 210 | -466 | -720 | 275 | 394 | 45 | 96 | 359 | 117 | -369 | -294 | -249 | |
| 106 | -3 | -9550 | -10592 | -894 | -1115 | -701 | -1378 | * | * | | | | | | | | | | | | |
| | 1269 | -3316 | 601 | -183 | -3637 | -503 | 2003 | -3387 | 1102 | -1799 | -2405 | 470 | -2910 | 662 | 532 | -1029 | 223 | -856 | -3499 | -237 | 129 |
| | -149 | -500 | 233 | 43 | -381 | 399 | 106 | -626 | 210 | -466 | -720 | 275 | 394 | 45 | 96 | 359 | 117 | -369 | -294 | -249 | |
| 107 | -3 | -9550 | -10592 | -894 | -1115 | -701 | -1378 | * | * | | | | | | | | | | | | |
| | 2132 | -334 | -4404 | -3773 | -779 | -3637 | -2512 | 19 | -1401 | -320 | -1123 | -3274 | -3687 | -3007 | -3189 | 887 | -2030 | 2059 | -2386 | -2043 | 130 |
| | -149 | -500 | 233 | 43 | -381 | 399 | 106 | -626 | 210 | -466 | -720 | 275 | 394 | 45 | 96 | 359 | 117 | -369 | -294 | -249 | |
| 108 | -3 | -9550 | -10592 | -894 | -1115 | -701 | -1378 | * | * | | | | | | | | | | | | |
| | -1912 | -3017 | -1930 | 800 | -3212 | -2947 | -1618 | -2375 | -1250 | -2975 | 2135 | -1653 | -3035 | 3555 | -353 | -997 | -562 | 30 | -3281 | -2693 | 131 |
| | -149 | -500 | 233 | 43 | -381 | 399 | 106 | -626 | 210 | -466 | -720 | 275 | 394 | 45 | 96 | 359 | 117 | -369 | -294 | -249 | |
| 109 | -3 | -9550 | -10592 | -894 | -1115 | -701 | -1378 | * | * | | | | | | | | | | | | |
| | 329 | -3316 | 547 | 853 | -3637 | -74 | -461 | -3388 | 648 | -1400 | -2405 | 927 | -2910 | 2110 | 1126 | -131 | -960 | -2938 | -3499 | -2817 | 132 |
| | -149 | -500 | 233 | 43 | -381 | 399 | 106 | -626 | 210 | -466 | -720 | 275 | 394 | 45 | 96 | 359 | 117 | -369 | -294 | -249 | |
| 110 | -3 | -9550 | -10592 | -894 | -1115 | -701 | -1378 | * | * | | | | | | | | | | | | |
| | 1081 | -3316 | -485 | -1 | -655 | -1502 | -1475 | -3387 | 492 | -1817 | -2405 | 2234 | -2910 | 968 | 702 | 651 | -218 | -2938 | -3499 | -2816 | 133 |
| | -149 | -500 | 233 | 43 | -381 | 399 | 106 | -626 | 210 | -466 | -720 | 275 | 394 | 45 | 96 | 359 | 117 | -369 | -294 | -249 | |

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4   -8455     -4
NULT      -4  -8455
NULE     595  -1558    85    338   -294  -1115  -1158     -4   902  -1085   -142    -21   -313    45    531    201    384  -1998   -644
HMM        A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -3 | | | | | | | | | | | | | | | | | | | | |
| 111 | -2379 | -4629 | -10592 | -4310 | -3233 | -5439 | 3037 | 1554 | -4835 | * | -4562 | -3855 | -3199 | -4471 | -2131 | 1794 | -3738 | -3605 | -1541 | -4465 | -4291 | 134 |
| | -149 | -500 | -500 | -500 | -381 | -381 | -701 | 106 | -626 | * | 875 | -466 | -720 | 275 | 394 | 45 | 96 | 359 | 117 | -369 | -294 | -249 |
| | -3 | -9550 | -10592 | -894 | -1115 | -701 | -1378 | | | | | | | | | | | | | | |
| 112 | 694 | -3313 | 163 | 2013 | -3632 | -2820 | -1479 | -3381 | 1536 | -804 | -2403 | -1457 | -2914 | -1020 | 1568 | -887 | -797 | -2934 | 923 | -2817 | 135 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 113 | -323 | 1120 | -4344 | -3712 | 247 | -3601 | -2469 | -240 | -1332 | 2332 | -1098 | -646 | -1255 | -2955 | -545 | -2683 | -2000 | -679 | -2352 | 1963 | 136 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 114 | -4451 | -3901 | -7015 | -6567 | -3002 | -6829 | -6062 | 744 | -6450 | 2011 | 1626 | -6513 | -6197 | -5660 | -6216 | -6199 | -4380 | 2735 | -4809 | -4848 | 137 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 115 | -7502 | -6257 | -6956 | -7316 | -6597 | -6224 | 5470 | -8888 | -7435 | -7924 | -7893 | -7283 | -6667 | -7369 | -6998 | -7889 | -7683 | -8284 | -6099 | -6304 | 138 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 116 | -7502 | -6257 | -6956 | -7316 | -6597 | -6224 | 5470 | -8888 | -7435 | -7924 | -7893 | -7283 | -6667 | -7369 | -6998 | -7889 | -7683 | -8284 | -6099 | -6304 | 139 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 117 | -2651 | -3259 | -5623 | -5970 | -5916 | -3527 | -5205 | -5778 | -5810 | -6031 | -5076 | -4306 | -4338 | -5289 | -5482 | -2669 | -1324 | -4469 | -6111 | -6072 | 140 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 118 | -5212 | -4579 | -5779 | -6972 | -5853 | -7362 | -5908 | -2068 | -6768 | 3255 | 319 | -7107 | -4306 | -5429 | -6189 | 2669 | -1324 | -2952 | -4373 | -4576 | 141 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 119 | 751 | -3208 | -5779 | -6119 | -782 | 3485 | -5219 | -5430 | -5868 | -5887 | -4971 | -4306 | -4309 | -5314 | -5502 | -2867 | -3084 | 146 | -6095 | -6062 | 142 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 120 | -3383 | -5118 | 3723 | 1062 | -5351 | -3589 | -2762 | -5198 | -2763 | -5098 | -72 | -202 | -4020 | -2392 | -1014 | -3114 | -1152 | -4709 | -5282 | -4399 | 143 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 121 | -4895 | -5084 | -6343 | -6718 | -7095 | 3848 | -6267 | -7596 | -6999 | -7455 | -6893 | -6032 | -5861 | -6658 | -6640 | -4594 | -5331 | -6556 | -6371 | -7085 | 144 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 122 | -1856 | -3327 | 2884 | 753 | -3646 | -2826 | -1488 | -1726 | 620 | -3342 | -2416 | 1379 | -2921 | -1029 | -139 | -1312 | 372 | -850 | -3510 | -2828 | 145 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4
NULT     -4 -8455
NULE    595 -1558  85  338 -294  453 -1158   -4  197  249  902 -1085 -142  -21 -313   45  531  201  384 -1998 -644
HMM       A     C   D    E    F    G    H    I    K    L    M    N    P    Q    R    S    T    V    W    Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 123 | -6226 | -5136 | -6586 | -6947 | 4390 | -6472 | 641 | -5112 | -6503 | -4414 | -4512 | -5080 | -6327 | -5222 | -5864 | -5723 | -6075 | -5269 | -1900 | 1459 | 146 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 124 | -98 | -3316 | 2335 | 695 | -3637 | 292 | 939 | -3388 | -178 | -1874 | -294 | 347 | -2910 | 212 | 621 | 527 | -1782 | -2938 | -3499 | -2817 | 147 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 125 | -1969 | -3424 | 499 | -1237 | -3741 | -2909 | 4427 | -3484 | -460 | -3434 | -117 | 1728 | -3018 | -1130 | -630 | -531 | -788 | -3045 | -3605 | -2929 | 148 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 126 | -4377 | -3919 | -6247 | -5959 | 4054 | -5797 | -3218 | 415 | -5594 | -2233 | 453 | -5033 | -5613 | -4783 | -5225 | -4975 | -4289 | -623 | -2516 | 1996 | 149 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 127 | 130 | -1996 | -3693 | -1282 | 1123 | -1049 | -2322 | 733 | -2825 | 103 | 2119 | -2892 | -3550 | -671 | 861 | 1302 | -880 | -1418 | -2440 | 1409 | 150 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 128 | -1093 | -3427 | -454 | -139 | -3756 | -2910 | 1303 | -3500 | 1564 | -3437 | -2518 | 1645 | -3010 | -1108 | 2875 | -1838 | -1051 | -3054 | -3596 | -2924 | 151 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 129 | -1644 | 2504 | -5250 | -4717 | -2755 | -4352 | -3600 | 956 | -4367 | -2313 | 4736 | -4165 | -4476 | -4020 | -4204 | -1910 | -2754 | -103 | -3445 | -3095 | 152 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 130 | 1364 | -2018 | -1276 | -2999 | 1987 | -3472 | 1052 | -853 | -2743 | -1875 | 1530 | -2833 | -3531 | -43 | -2812 | 1185 | -1970 | -292 | -2458 | 2041 | 153 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 131 | 999 | -3546 | -1981 | 1759 | -3905 | -3063 | -1660 | -3626 | 1724 | -3544 | -2640 | -1700 | -3148 | 927 | 1869 | 132 | -2046 | -3192 | -3678 | -3050 | 154 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 132 | -511 | -4187 | -616 | 3053 | -4478 | -3254 | 1223 | -4263 | -1900 | -4193 | -3314 | -1870 | 1602 | 948 | -2474 | -1151 | -2588 | -3799 | -4366 | -3610 | 155 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 133 | -3940 | -3424 | -6611 | -6275 | 1633 | -6450 | -6279 | 2805 | -6229 | -1337 | -2513 | -6102 | -6133 | -6047 | -6330 | -5822 | -3923 | 2664 | -5509 | -5086 | 156 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 134 | -1819 | 1338 | -5951 | -6288 | -5880 | -3460 | -5233 | -5688 | -5905 | -5962 | -4992 | -4303 | -4277 | -5338 | -6330 | 825 | 3769 | -4379 | -6108 | -6092 | 157 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 135 | 910 | 3533 | -4896 | -387 | -2550 | -4151 | -3262 | -192 | -3997 | -2235 | -1707 | -3863 | -4252 | -3669 | -3869 | -3287 | 819 | 2580 | -3163 | -2807 | 158 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455    -4   -8455   -1000  -1000  -8455   -4   -8455   -4            -1085  -142   -21   -313   45   531   201   384  -1998  -644
NULT   -4       -8455
NULE   595      -1558
HMM    A        C       D      E      F       G      H       I            M      N      P      Q      R    S     T     V    W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -149 | -9550 | -10592 | -894 | -1115 | -701 | -1378 | * | * | | | | | | | | | | | | |
| 136 | 3291 | -2359 | -4831 | -4349 | -611 | -2819 | -3181 | -428 | -3975 | -2530 | -1885 | -3628 | -3933 | -3599 | -3794 | -934 | -1230 | -69 | -3155 | -2824 | 159 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | | -1115 | -701 | -1378 | * | * | | | | | | | | | | | | |
| 137 | 175 | -3308 | -1756 | -676 | -3618 | -2866 | -605 | -3352 | -1093 | -3318 | -2408 | -1512 | -2960 | 3611 | 723 | 297 | 205 | -1467 | -3502 | -2838 | 160 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | | -1115 | -701 | -1378 | * | * | | | | | | | | | | | | |
| 138 | 2656 | -3129 | -4534 | -1425 | -5015 | 293 | -4142 | -4719 | -4239 | -4955 | -4101 | -3700 | -4103 | -3992 | -4393 | 288 | 2198 | -886 | -5249 | -4951 | 161 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 139 | -1370 | -55 | -449 | -1452 | -881 | -3377 | -2170 | 847 | -1336 | 303 | 1215 | 1211 | -3442 | -689 | 800 | 544 | -1766 | 390 | 386 | 1832 | 162 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 140 | -4666 | -4085 | -7206 | -6739 | -2888 | -7059 | -6171 | 2059 | -6623 | 2843 | -1638 | -6762 | -6284 | -5663 | -6301 | -6464 | -4576 | -17 | -4746 | -4868 | 163 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 141 | -1965 | -2646 | -509 | -1738 | -2748 | -3094 | -1837 | -1635 | -1495 | -2576 | 686 | 312 | -3193 | -1553 | -2049 | 213 | 3394 | -1410 | -3014 | -2300 | 164 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 142 | 1213 | -3367 | -1730 | 1318 | -3673 | -2897 | -1585 | -3409 | -475 | -3381 | -2475 | -452 | 2985 | -393 | -1684 | -1836 | -870 | -656 | -3571 | -2900 | 165 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 143 | 1241 | -3285 | 416 | 2538 | -3591 | -1180 | -1489 | -3330 | -1076 | -3295 | 892 | -1469 | -2921 | 1325 | -1581 | -1107 | -1236 | -1083 | -3478 | -529 | 166 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 144 | -3916 | -5618 | -614 | -2077 | -6074 | -3789 | 1523 | -6152 | -3669 | -6012 | -5421 | 4062 | -4389 | -3004 | -4565 | -3604 | 694 | -5528 | -6138 | -5077 | 167 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 145 | 3567 | 978 | -5981 | -6297 | -5716 | -3512 | -5246 | -4854 | -5908 | -5616 | -4816 | -4347 | -4320 | -5358 | -5517 | -2879 | -3081 | -1006 | -6042 | -5983 | 168 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 146 | 2015 | 2840 | -2231 | -240 | -2709 | -2225 | -1171 | -2314 | -690 | -1157 | -1780 | -1893 | -3145 | 323 | -1136 | -2012 | 1538 | 614 | -2967 | -2466 | 169 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 147 | 923 | -3292 | -301 | 1102 | -202 | -2823 | 414 | -3345 | -652 | -3303 | -665 | -1462 | -2916 | 436 | 145 | 858 | 1333 | -383 | -3482 | 1173 | 170 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| XT | -8455 | -4 | -1000 | -1000 | -8455 | -4 | -8455 | -4 | | | | | | | | | | | | | |
| NULT | -4 | -8455 | | | | | | | | | | | | | | | | | | | |
| NULE | 595 | -1558 | 85 | 338 | -294 | 453 | -1158 | 197 | 249 | 902 | -1085 | -142 | -21 | -313 | 45 | 531 | 201 | 384 | -1998 | -644 | |
| HMM | A | C | D | E | F | G | H | I | K | L | M | N | P | Q | R | S | T | V | W | Y | |
| | -3 | -9550 | -10592 | -894 | -1115 | -701 | -1378 | | * | | | | | | | | | | | | |
| 148 | -4746 | -6080 | -2405 | 3890 | -6602 | -4417 | -3936 | -6827 | -4165 | -6572 | -6094 | -3175 | -4990 | -741 | -4816 | -4411 | -4860 | -6287 | -6258 | -5679 | 171 |
| | -149 | -500 | -500 | -500 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 149 | -4076 | -3559 | -6706 | -6388 | -414 | -6496 | -5943 | 3936 | -6329 | -2305 | -2377 | -6165 | -6165 | -5988 | -6348 | -5884 | -4060 | -353 | -5056 | -4492 | 172 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 150 | -5479 | -6001 | 3976 | -3923 | -7144 | -5083 | -4963 | -7619 | -5514 | -7306 | -6919 | -4269 | 1563 | -4832 | -6140 | -5307 | -5677 | -7002 | -6429 | -6542 | 173 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 151 | -4157 | -4830 | -4021 | -3534 | -5941 | -1516 | -1890 | -5459 | -1622 | -5102 | -4460 | -901 | -4750 | -2562 | 4104 | -4087 | -4040 | -5106 | -4880 | -4739 | 174 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 152 | -1230 | -3448 | -6531 | -6232 | -3676 | -5893 | -5997 | -987 | -6117 | 931 | -2429 | -5853 | -5865 | -5826 | -6112 | -5253 | -3873 | 3499 | -5328 | -5018 | 175 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 153 | -5088 | -4460 | -7490 | -6961 | -2671 | -7311 | -6082 | 2574 | -6794 | 2731 | -1438 | -7088 | -6341 | -5551 | -6284 | -6778 | -4945 | -2519 | -4528 | -4735 | 176 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 154 | -502 | 256 | -1082 | -2 | -2047 | -122 | 1156 | -732 | -1110 | -1537 | -2310 | 887 | -2937 | -589 | 2094 | 478 | 950 | -79 | -3420 | -2767 | 177 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 155 | 1627 | -292 | -837 | 1625 | -3365 | -2085 | -1537 | -432 | -1156 | -2323 | -84 | -1541 | -2960 | 886 | -648 | 258 | 1201 | -834 | -3358 | -2728 | 178 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 156 | 2052 | 3609 | -4698 | -4082 | -2140 | -3930 | -2844 | 91 | -3696 | -879 | 2232 | -3581 | -3969 | -3330 | -3510 | -1969 | -2275 | 1429 | -2699 | -2353 | 179 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 157 | -1253 | -1905 | -4366 | -3734 | -437 | -3613 | 491 | 265 | -3338 | 2361 | -1105 | -3241 | -3663 | -936 | 508 | -2696 | -2012 | -1127 | 3469 | -257 | 180 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 158 | -150 | -3304 | -1696 | 409 | -381 | -2820 | 282 | -3366 | 1001 | 306 | -2394 | 495 | -2913 | 923 | 866 | -6 | 1115 | -2813 | -3490 | 909 | 181 |
| | -149 | -500 | 233 | 5 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 159 | -539 | -3316 | -672 | 2553 | -3637 | -2818 | 1060 | -3388 | 531 | -3332 | -1076 | -1453 | -2911 | 2520 | -1033 | -1299 | -927 | -2938 | -3500 | -533 | 182 |
| | -149 | -500 | 233 | -894 | -1115 | -701 | -1378 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455    -4
NULT     -4 -8455
NULE    595 -1558   85  338  -294  453 -1158  197  249  902 -1085 -142  -21 -313   45  531  201  384 -1998  -644
HMM       A     C    D    E     F    G     H    I    K    L     M    N    P    Q    R    S    T    V     W     Y
```

| | A | C | D | E | F | G | H | I | K | L | M | N | P | Q | R | S | T | V | W | Y |
|---|---|---|---|---|---|---|---|---|---|---|---|---|---|---|---|---|---|---|---|---|
| 160 | -4547 | -5064 | -5790 | -3852 | -6075 | -4958 | 2134 | -5253 | 2618 | -4829 | -4196 | -3620 | -4840 | 137 | 3153 | -4410 | -4131 | -5069 | -4615 | -4610 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 161 | -4564 | -5065 | -5836 | -3885 | -6043 | -4971 | -2702 | -5252 | 1617 | -539 | -4204 | -3646 | -4858 | -2283 | 3786 | -4432 | -4151 | -5075 | -4624 | -4616 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 162 | -7208 | -6181 | -7133 | -7515 | -7691 | -6164 | -6829 | -8742 | -7718 | -8131 | -8044 | -7415 | 4335 | -7586 | -7182 | -7628 | -7478 | -8268 | -6469 | -7677 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 163 | -3730 | -4124 | -6140 | -6456 | -6100 | 2458 | -5821 | -4478 | -6441 | -5830 | -5367 | -5254 | -5201 | -6048 | -6124 | -4044 | -4165 | 3194 | -6172 | -6356 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 164 | -1778 | -4990 | -6249 | -6499 | -1236 | -6174 | 3804 | -4988 | -5932 | -2253 | -4410 | -4962 | -6148 | -5061 | -5496 | -5454 | -5708 | -5098 | -1956 | 4251 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 165 | -4822 | -4224 | -7325 | -6829 | -2786 | -7176 | -6144 | 2946 | -6695 | 2440 | -1541 | -6896 | -6308 | -5612 | -6296 | -6591 | -4713 | -1401 | -4651 | -4819 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 166 | -728 | -2491 | -2396 | -820 | -529 | -1480 | 2449 | -2137 | -1709 | 551 | 2170 | 1357 | -3205 | 2107 | -2090 | -684 | -1878 | 310 | -2859 | -2389 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 167 | -4893 | -4287 | -7376 | -6861 | -2739 | -7226 | -6120 | 950 | -6718 | 3118 | -1495 | -6949 | -6313 | -5580 | -6283 | -6641 | -4773 | -350 | -4604 | -4797 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 168 | 351 | -3207 | -5609 | -5961 | -5915 | -3477 | -5187 | -5749 | -5823 | -6005 | -5035 | -4261 | 3981 | -5265 | -5483 | 391 | -3074 | -4422 | -6127 | -6096 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 169 | 858 | 18 | -4361 | -3729 | -1853 | -1566 | -2476 | 1879 | -3335 | -1127 | 661 | -3236 | -559 | -2961 | -3152 | 1258 | 1322 | 965 | -2355 | -2012 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 170 | -4148 | -6239 | 4058 | -1433 | -6359 | -3835 | -3318 | -6393 | -3797 | -6207 | -5687 | 278 | -4442 | -3020 | -4863 | -3737 | -4263 | -5812 | -6393 | -5231 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 171 | -3900 | -3378 | -6602 | -6299 | -4061 | -6478 | -6611 | 1567 | -6289 | -1856 | -2736 | -6137 | -6191 | -6262 | -6484 | -5878 | -3892 | 3579 | -5900 | -5369 |
|   | -149 | -500 | 233 | 43 | -381 | 399 | 106 | -626 | 210 | -466 | -720 | 275 | 394 | 45 | 96 | 359 | 117 | -369 | -294 | -249 |
|   | -3 | -9550 | -10592 | -894 | -1115 | -701 | -1378 | * | * | | | | | | | | | | | |
| 172 | 3057 | -1041 | -4882 | -4509 | -3304 | -2259 | -3576 | -2874 | -4191 | -3213 | -2525 | -3711 | -1138 | -3845 | -4086 | -1345 | 823 | -1048 | -3757 | 1527 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455    -4
NULT    -4  -8455
NULE   595 -1558   85  338 -294  453 -1158   -4  197  249  902 -1085 -142  -21 -313   45  531  201  384 -1998 -644
HMM              A     C     D     E     F     G     H     I     K     L     M     N     P     Q     R     S     T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 173 | 0 | -3315 | 102 | 1168 | -3636 | -1401 | 2205 | -918 | 931 | -699 | 1006 | 757 | -2910 | 468 | 1097 | -203 | -1782 | -2937 | -3499 | -2816 | 196 |
| | -149 | -500 | 233 | 43 | -1115 | -701 | 106 | -626 | 210 | -466 | -720 | 275 | 394 | 45 | 96 | 359 | 117 | -369 | -294 | -249 | |
| | -3 | -9550 | -10592 | -894 | | | -1378 | * | | | | | | | | | | | | | |
| 174 | 1333 | -2026 | -3421 | -2835 | 626 | -3415 | -2228 | -786 | 1533 | -311 | 1018 | -2722 | -3476 | -583 | -611 | -85 | 1127 | 804 | -2462 | -2088 | 197 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9519 | -10562 | | | | -1929 | * | | | | | | | | | | | | | |
| 175 | 139 | -3260 | -427 | 1805 | -3566 | -2802 | -1462 | -869 | 479 | -2409 | -2353 | -1443 | 2641 | -419 | -1554 | -912 | -494 | -701 | -3452 | -2778 | 198 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9519 | -10562 | -894 | -1115 | -701 | -1751 | * | * | | | | | | | | | | | | |
| 176 | 992 | 350 | -5269 | -4703 | -2721 | -4602 | 3614 | 2819 | -4367 | 179 | -705 | -4249 | -4594 | -4041 | -4222 | -3732 | 388 | 1547 | -3433 | -3068 | 199 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 177 | -178 | -3299 | -681 | 2271 | -3613 | -1174 | -1480 | -516 | -1064 | -3312 | -2391 | 809 | -57 | 547 | -1570 | 306 | 429 | 25 | -3487 | 11 | 200 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 178 | 399 | -2224 | -2925 | -2354 | -2230 | -3307 | -2078 | 980 | 1150 | -1510 | -1411 | -2407 | 2228 | -2030 | -290 | -362 | -381 | 1376 | -2638 | -2230 | 201 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 179 | -295 | -3330 | 69 | -11 | -3651 | -2826 | -8 | -3402 | -564 | -3346 | -2420 | -957 | 3341 | -246 | 5 | -333 | -378 | -2952 | -3514 | -2830 | 202 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 180 | 688 | -3299 | 527 | 732 | -3619 | -1525 | -156 | -2662 | -53 | -2113 | -2388 | -536 | 799 | 175 | -1431 | 1104 | 1315 | -176 | -3483 | -930 | 203 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9530 | -10572 | -894 | -1115 | -563 | -1630 | * | * | | | | | | | | | | | | |
| 181 | 1449 | -3316 | -279 | 901 | -3637 | -748 | -545 | -3387 | -20 | -1096 | -98 | 500 | 334 | 858 | -608 | 257 | 714 | -2938 | -3499 | -839 | 204 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 182 | 687 | -2468 | -2431 | -1872 | 891 | -2446 | -1867 | -1089 | 671 | -2363 | -1637 | -2047 | 2908 | -665 | -1235 | 104 | -1342 | -334 | -2840 | -375 | 205 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 183 | -685 | -2101 | -1851 | -556 | 556 | -3395 | -2193 | 587 | -238 | 2459 | -661 | -2628 | -1101 | -544 | -2634 | -1241 | -1951 | -950 | -2531 | -2146 | 206 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 184 | 485 | -56 | -991 | -917 | -2512 | -1566 | -1871 | 174 | -402 | 636 | 1452 | -1100 | 1300 | -94 | -2120 | -849 | 595 | 1051 | -2835 | -2371 | 207 |
| | -149 | -500 | 233 | 43 | -381 | 399 | 106 | -626 | 210 | -466 | -720 | 275 | 394 | 45 | 96 | 359 | 117 | -369 | -294 | -249 | |

| | | | | | | | | | | | | | | | | | | | | | | |
|---|---|---|---|---|---|---|---|---|---|---|---|---|---|---|---|---|---|---|---|---|---|---|
|HMMER2.0 [2.2 g]| | | | | | | | | | | | | | | | | | | | | | |
|NAME|sel_kivd| | | | | | | | | | | | | | | | | | | | | |
|LENG|562| | | | | | | | | | | | | | | | | | | | | |
|ALPH|Amino| | | | | | | | | | | | | | | | | | | | | |
|RF|no| | | | | | | | | | | | | | | | | | | | | |
|CS|no| | | | | | | | | | | | | | | | | | | | | |
|MAP|yes| | | | | | | | | | | | | | | | | | | | | |
|COM|hmmbuild -n sel_kivd sel_kivd.hmm sel_kivd.aln.fa| | | | | | | | | | | | | | | | | | | | | |
|NSEQ|170| | | | | | | | | | | | | | | | | | | | | |
|DATE|Wed Apr. 25 16:17:47 2012| | | | | | | | | | | | | | | | | | | | | |
|CKSUM|3974| | | | | | | | | | | | | | | | | | | | | |
|XT|−8455|−4|−8455|−1000|−1000|−8455|−4|−8455|−4| | | | | | | | | | | | | |
|NULT|−4|−8455| | | | | | | | | | | | | | | | | | | | |
|NULE|595|−1558|85|338|−294|453|−1158|197|249|902|−1085|−142|−21|−313|45|531|201|384|−1998|−644| | |
|HMM|A|C|D|E|F|G|H|I|K|L|M|N|P|Q|R|S|T|V|W|Y| | |
| | | | | | | | | | | | | | | | | | | | | | | |
| |−193|−9550|−3014|−894|−1115|−701|−1378|*|*|1075|−1102|406|919|−357|−137|−1590|804|−382|−3320|−122|208| |
|185|−904|−3125|814|351|−3425|−2682|1036|−1436|−43|−877|−2405|−570|1345|177|1285|522|5|−1842|−3499|37|209| |
| |−149|−500|−149|−894|−381|399|106|−626|210|−466|−720|275|394|45|96|359|117|−369|−294|−249| | |
| |−3|−9360|−10402|−894|−1115|−217|−2839|*|*|−466|−720|275|394|45|96|359|117|−369|−294|−249| | |
|186|56|−918|−892|1035|−3636|−1008|153|−3387|614|473|−2396|−556|862|1430|568|−616|739|−709|−3492|462|210| |
| |−149|−500|233|43|−381|399|106|−626|210|−466|−720|275|394|45|96|359|117|−369|−294|−249| | |
| |−3|−9550|−10592|−894|−1115|−701|−1378|*|*| | | | | | | | | | | | | |
|187|−17|−3306|−341|293|−3622|−2819|1297|−1375|−356|−3175|−48|−1475|2558|−1041|−670|10|−250|−1235|−3392|−2740|211| |
| |−149|−500|233|43|−381|399|106|−626|210|−466|−720|275|394|45|96|359|117|−369|−294|−249| | |
| |−36|−9550|−5406|−894|−1115|−701|−1378|*|*| | | | | | | | | | | | | |
|188|794|−3180|−543|432|−468|−2030|339|176|6|−261|184|−726|182|1713|−563|639|−501|−15|−3479|−2477|212| |
| |−149|−500|233|43|−381|399|106|−626|210|−466|−720|275|394|45|96|359|117|−369|−294|−249| | |
| |−3|−9516|−3938|−894|−1115|−494|−1786|*|*| | | | | | | | | | | | | |
|189|64|368|873|593|−3597|−471|576|−2180|−1069|87|−1328|−2315|−1611|408|−1561|2032|−65|241|−255|−436|213| |
| |−149|−500|233|43|−381|399|106|−626|210|−466|−720|275|394|45|96|359|117|−369|−294|−249| | |
| |−99|−9550|−10558|−894|−1115|645|16|*|*| | | | | | | | | | | | | |
|190|−282|−512|−2828|−1434|−170|399|106|−254|−1356|−5268|−4626|2537|3758|−2270|−3810|−2978|1764|−4865|−5467|−4408|214| |
| |−149|−500|233|43|−381|−1642|−557|−626|210|−466|−720|275|394|45|96|359|117|−369|−294|−249| | |
| |−486|−9453|−1814|−894|−1115|−701|−1378|*|*| | | | | | | | | | | | | |
|191|−3333|−5277|2899|−255|−5465|−807|−2594|−5412|−2900|−1717|−2256|−1453|754|245|−100|1874|−500|490|−3499|−2817|215| |
| |−149|−500|233|43|−381|399|106|−626|210|−466|−720|275|394|45|96|359|117|−369|−294|−249| | |
| |−4|−8972|−10014|−894|−1115|−101|−3889|*|*| | | | | | | | | | | | | |
|192|−951|−3316|1033|477|−3637|−1345|−1476|−3387|1097|−3332|−2405|179|1286|1023|−875|522|−377|−2938|−3499|−19|216| |
| |−149|−500|233|43|−381|399|106|−626|210|−466|−720|275|394|45|96|359|117|−369|−294|−249| | |
| |−3|−9550|−10592|−894|−1115|−701|−1378|*|*| | | | | | | | | | | | | |
|193|−417|−3316|1110|1514|−3637|−2817|−107|−3388|432|−1539|−2405|500|−2765|319|1158|−199|1169|−2788|−3351|−2669|217| |
| |−149|−500|233|43|−381|399|106|−626|210|−466|−720|275|394|45|96|359|117|−369|−294|−249| | |
| |−193|−9550|−3015|−894|−1115|−701|−1378|*|*| | | | | | | | | | | | | |
|194|1392|−3167|581|1107|−3486|−1501|−1331|−584|−912|−1717|−859|−2959|−3477|1196|−2911|1054|−1271|533|−2283|−1933|218| |
| |−149|−500|233|43|−381|399|106|−626|210|−466|−720|275|394|45|96|359|117|−369|−294|−249| | |
| |−3|−10402|−10402|−894|−1115|−2161|−365|*|*| | | | | | | | | | | | | |
|195|1595|1189|−3929|−3322|−1791|−3401|−2300|−1325|−2989|1524|−2077|−207|−2728|854|487|−1548|−1579|82|−3191|−2543|219| |
| |−149|−500|233|43|−381|399|106|−626|210|−466|−720|275|394|45|96|359|117|−369|−294|−249| | |
| |−94|−9360|−4016|−894|−1115|−2161|−365|*|*| | | | | | | | | | | | | |
|196|−121|−65|741|580|−3239|−2636|−1301|−2111|−376|1823|−2077|−207|−2728|854|487|−1548|−1579|82|−3191|−2543| | |
| |−149|−500|233|43|−381|399|106|−626|210|−466|−720|275|394|45|96|359|117|−369|−294|−249| | |
| |−3|−9269|−10312|−894|−1115|−167|−3191|*|*| | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4  -8455     -4  -8455     -4  -8455     -4
NULT      -4  -8455
NULE     595  -1558 -1000 -1000 -1000  -294   453  -1158    -4   197   249   902 -1085  -142   -21  -313    45   531   201   384 -1998  -644
HMM        A      C     D     E     F     G     H     I     K     L     M     N     P     Q     R     S     T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 197 | 1478 | -3294 | -1703 | 641 | -3604 | -2823 | -1483 | -1763 | 1315 | -1356 | -2386 | -1463 | -2916 | 2142 | -41 | 553 | -122 | -1071 | -3483 | -2807 | 220 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 198 | 2314 | -1906 | -718 | -712 | 560 | -1707 | -2453 | 194 | -3260 | -80 | 2103 | -3188 | -3641 | -2910 | -3111 | -2668 | -1998 | -582 | -2361 | 1787 | 221 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 199 | 217 | -2387 | -5003 | -4397 | 3415 | -4270 | -3192 | 1266 | -4024 | 226 | -314 | -3918 | -4273 | -3642 | -3838 | -3377 | -1261 | 1139 | -2996 | -2669 | 222 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 200 | -407 | -1064 | 792 | 263 | -3592 | -2825 | -1482 | 584 | 598 | -700 | -174 | 455 | -2917 | 618 | 1453 | -305 | 733 | -106 | -3477 | -2803 | 223 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 201 | 467 | -3298 | 1205 | 1209 | -3610 | -1402 | 1716 | -1284 | 686 | -844 | 1509 | -1460 | -2914 | 170 | 590 | -1728 | -622 | -1334 | -3486 | 709 | 224 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 202 | 2225 | 404 | -1284 | -1624 | -1979 | -3481 | 819 | 1211 | -2777 | 212 | -1205 | -2858 | -3539 | -1435 | -1516 | -1527 | -478 | 1170 | -2450 | -2085 | 225 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 203 | 2320 | 342 | -3573 | -336 | -775 | -3468 | -2290 | -245 | 112 | 620 | -1217 | -2823 | -1531 | 5 | -2803 | -2511 | -225 | 659 | -2462 | -2094 | 226 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 204 | 116 | -3316 | 709 | 1633 | -3637 | -2817 | -1475 | -1069 | 534 | -3332 | -2405 | -93 | -1403 | 458 | 1532 | 977 | 146 | -2938 | -3499 | -2817 | 227 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 205 | 558 | 652 | -822 | 955 | -3633 | -1383 | 734 | -59 | 1665 | -3329 | -98 | -1063 | -2911 | 1062 | 984 | 407 | -1079 | -1383 | -3497 | -2815 | 228 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 206 | -2061 | 46 | -4377 | -3743 | 592 | -3605 | -572 | 1161 | 72 | 2217 | 1211 | -3242 | -3656 | -1516 | 609 | -2689 | -2002 | -532 | -2349 | -615 | 229 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 207 | 61 | -3237 | -883 | 546 | -1254 | -2837 | 345 | 234 | 508 | 1837 | -511 | 921 | -2930 | 259 | -580 | -1071 | -1789 | -2840 | -3442 | -2781 | 230 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 208 | 924 | -3316 | -724 | -184 | -3637 | -207 | 567 | -3388 | 697 | -1142 | 386 | 546 | -1156 | 1439 | -234 | 1558 | -1009 | -2938 | -3499 | -2816 | 231 |
|  | -147 | -500 | 233 | 43 | -381 | 399 | 106 | -626 | 210 | -466 | -720 | 275 | 394 | 45 | 96 | 359 | 117 | -369 | -294 | -249 | |
|  | -1442 | -5546 | -712 | -1428 | -670 | -701 | -1378 | * | * | | | | | | | | | | | | |
| 209 | 52 | -2375 | -69 | 90 | -2692 | -85 | -546 | -2440 | 662 | -2389 | -360 | 855 | 1027 | -88 | -635 | 1446 | 742 | -1995 | -2561 | -1881 | 235 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455
NULT  -4    -8455
NULE  595  -1558
HMM       A       C       D       E       F       G       H       I       K       L       M       N       P       Q       R       S       T       V       W       Y
         -149    -500    233     43      -381    399     106     -626    210     -466    -720    275     394-88  45      96      359     117     -369    -294    -249
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 210 | 2779 | -8192 | -9234 | -894 | -1115 | -58 | -4653 | * | * | -3624 | -2712 | -552 | -3136 | -1294 | -763 | 1059 | -852 | -3218 | -3798 | -3103 | 236 |
| | -149 | -500 | -409 | -388 | -3918 | -45 | -1741 | -3674 | -1369 | -466 | -720 | 275 | 394 | 45 | 96 | 359 | 117 | -369 | -294 | -249 | |
| | -3 | -9550 | -10592 | -894 | -1115 | -701 | -1378 | -626 | 210 | | | | | | | | | | | | |
| 211 | -467 | -494 | -771 | -1142 | -3637 | -1559 | 1915 | -3388 | 2428 | -3332 | -2406 | -519 | -676 | 1055 | 1641 | 178 | -1470 | -2938 | -3500 | -2817 | 237 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 212 | -282 | -3316 | 24 | -512 | -1347 | -1327 | -1476 | -3388 | 1479 | -3332 | -2405 | -73 | -2910 | 2026 | 2211 | 132 | -35 | -2938 | -3500 | -2817 | 238 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 213 | -2295 | -2108 | -4597 | -3977 | -2068 | -3876 | -2766 | 398 | -3594 | -194 | -233 | -3503 | 3005 | 32 | -3423 | -2966 | 351 | 1867 | -2632 | -2291 | 239 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 214 | 1796 | -1922 | -4253 | -3631 | -1885 | -1609 | 26 | 1264 | -3262 | -957 | -1130 | -3191 | -3649 | -2916 | -3120 | 540 | 965 | 1745 | -2385 | -2039 | 240 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 215 | -4311 | -3769 | -6913 | -6502 | -3174 | -6745 | -6161 | -2536 | -6411 | 1908 | 518 | -6420 | -6195 | -5768 | -6268 | -6122 | -4258 | 2011 | -4984 | -4945 | 241 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 216 | -5108 | -4472 | -7528 | -6958 | -2625 | -7385 | -6070 | 1776 | -6792 | 2969 | 237 | -7116 | -6334 | -5507 | -6260 | -6802 | -4951 | -1315 | -4493 | -4743 | 242 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 217 | 3173 | -3117 | -5983 | -5798 | -4068 | -4413 | -5073 | 748 | -5543 | -3238 | -2967 | -4819 | -4914 | -5229 | -5412 | -3740 | 930 | 218 | -5085 | -4728 | 243 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 218 | -5226 | -5864 | 3782 | -3755 | -7088 | 1863 | -4825 | -7475 | -5371 | -7202 | -6770 | -4093 | -5524 | -4670 | -6040 | -5069 | -5445 | -6801 | -6433 | -6456 | 244 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 219 | -738 | 17 | -4321 | -3691 | 2991 | -3599 | 2990 | -512 | -3305 | 501 | -1103 | -330 | -3650 | 532 | -3135 | -2680 | -2002 | -573 | -2354 | 830 | 245 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 220 | -3349 | -4496 | 456 | 2379 | -4509 | -770 | -2871 | -4175 | -2998 | 2186 | 1503 | -2332 | -4088 | -2574 | -3652 | -3201 | -3371 | -3977 | -4805 | -4115 | 246 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 221 | 2046 | -3272 | -6399 | -6083 | -4010 | -5884 | -5965 | 1906 | -5992 | -2872 | -2747 | -5735 | -5848 | -5892 | -6086 | -5223 | -886 | -2656 | -5546 | -5049 | 247 |
| | -149 | -500 | 233 | 43 | -381 | 399 | 106 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr 25 16:17:47 2012
CKSUM 3974
XT    -8455   -4    -8455  -1000   -1000  -8455   -4    -8455   -4
NULT  -4      -8455
NULE  595    -1558  85    338    -294   453   1158   -4   -8455
HMM       A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -3 | -9550 | -10592 | -894 | -1115 | -701 | -1378 | | | | | | | | | | | | | | |
| 222 | -54 | -3309 | 1635 | 35 | -3627 | -1897 | 2711 | -960 | -1059 | -188 | -2399 | 1803 | -2912 | 1139 | -862 | -640 | -998 | -2929 | -3494 | -944 | 248 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 223 | -3098 | -3625 | -5295 | -4451 | -5062 | -3953 | -3514 | -1610 | -2391 | -4620 | -4013 | -3861 | -4465 | -3223 | 3855 | 1097 | -3345 | -1405 | -4916 | -4712 | 249 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 224 | -480 | -2547 | -4958 | -4418 | 3548 | -4239 | 1638 | -2053 | -4012 | 224 | 874 | -3760 | -4269 | -3548 | -3778 | -3337 | -2703 | -1443 | 1578 | 1997 | 250 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | | | | | | | | | | | | | |
| 225 | -1425 | -3364 | -1163 | -1183 | -3687 | 2416 | 2428 | -3435 | 361 | -3378 | -2455 | 198 | -2954 | 2148 | -503 | -1375 | -1834 | -2987 | -3543 | -1963 | 251 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 226 | 1610 | 1808 | -4498 | -3864 | -209 | -3711 | -2584 | -474 | -3463 | 1911 | -572 | -3356 | -3753 | 248 | -3264 | -2797 | -2095 | 1205 | -2438 | -2102 | 252 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | | | | | | | | | | | | | |
| 227 | -137 | -3313 | -1692 | 594 | -3633 | -974 | 2438 | -1592 | 545 | -3329 | -2403 | -468 | -2911 | 2586 | 778 | -1725 | 765 | -564 | -3497 | -2816 | 253 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 228 | -1845 | -3319 | 291 | 1799 | -3640 | -1094 | 691 | -3390 | 1294 | -3335 | -2408 | 541 | 1027 | 1533 | -1118 | 477 | -726 | -2941 | -3502 | -2819 | 254 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 229 | 944 | -3302 | -1186 | 1085 | -1576 | -2820 | -1479 | -3363 | 173 | 302 | -2393 | -72 | -363 | 1636 | 105 | -629 | 315 | -179 | -3489 | 42 | 255 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 230 | -5010 | -4399 | -7433 | -6871 | 442 | -7248 | -5952 | -283 | -6694 | 3020 | -1400 | -6963 | -6282 | -5474 | -6195 | -6634 | -4864 | 860 | -4463 | -4655 | 256 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 231 | -234 | -3312 | -1692 | 1749 | -3631 | -2818 | 1564 | -2067 | 201 | -2127 | -2401 | 1286 | -2911 | 2118 | 473 | -1256 | -29 | -701 | -3496 | -254 | 257 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 232 | 888 | -3317 | 716 | 566 | -3638 | -643 | 724 | -3389 | 692 | -2427 | -2406 | 241 | -2910 | 2471 | 1217 | -1724 | -874 | -2939 | -3500 | -2817 | 258 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 233 | -3693 | -3374 | -5859 | -5351 | 2703 | -5234 | -3388 | 235 | -4974 | 1594 | -1643 | -4724 | -5090 | -4323 | -4673 | -4368 | -3609 | 20 | 4336 | -221 | 259 |
| | -149 | -500 | 233 | 43 | -381 | 399 | 106 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4   -8455   -1000   -1000   -8455     -4   -8455     -4
NULT     -4 -8455
NULE    595 -1558
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| HMM | | | | | | | | | | | | | | | | | | | | | |
| 234 | 399 | -1954 | -4475 | -3843 | -1913 | -3692 | -2570 | 1440 | -3443 | 1468 | 1971 | -3335 | -3738 | -3069 | -441 | -784 | -2075 | 1886 | -2433 | -2091 | 260 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 235 | 1306 | -3325 | 1068 | 1459 | -3646 | -2822 | 647 | -3397 | 98 | -3341 | -2414 | 1705 | -2916 | 827 | -1572 | -97 | 296 | -2835 | -3508 | -2825 | 261 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 236 | 543 | -3325 | 121 | 1683 | -3646 | -988 | -1483 | -3397 | 2259 | -2243 | -2415 | 113 | -2917 | 1584 | -390 | -1732 | -1791 | -2947 | -3508 | -2825 | 262 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 237 | -308 | 1517 | 85 | -3053 | -66 | -830 | -2314 | -489 | -2789 | -1868 | -1209 | -2867 | -3543 | -2543 | -840 | -522 | 2825 | 1160 | -2454 | -2089 | 263 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -61 | -9492 | -4652 | -894 | -1115 | -701 | -1378 | * | * | | | | | | | | | | | | |
| 238 | 337 | -3271 | -148 | -809 | -3592 | 984 | 912 | -3343 | 611 | -3287 | -2360 | 1200 | 1515 | 1127 | -507 | 67 | -1088 | -395 | -3454 | -2772 | 264 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10534 | -894 | -1115 | -409 | -2017 | * | * | | | | | | | | | | | | |
| 239 | -3691 | -3358 | -6072 | -5469 | 1503 | -5448 | -4297 | 2852 | -5134 | 1057 | 2147 | -5106 | -5208 | -4503 | -4862 | -4598 | -3608 | 880 | -3708 | -481 | 265 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 240 | 569 | -3220 | -5550 | -5905 | -5918 | -3487 | -5180 | -5756 | -5803 | -6011 | -5045 | -4258 | 4076 | -5253 | -5476 | -1468 | -3086 | -4433 | -6126 | -6090 | 266 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 241 | -1384 | 1643 | -4437 | -3803 | 102 | -3644 | 3614 | 1059 | -3400 | -723 | -1119 | -3288 | -3692 | -3022 | -3201 | -2729 | -2034 | 1693 | -2368 | 2105 | 267 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 242 | 3136 | -3152 | -5586 | -5725 | -5563 | -3456 | -4957 | -5305 | -5471 | -5590 | -4683 | -5106 | -4246 | -5008 | -5243 | -4598 | 974 | -594 | -5821 | -5708 | 268 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 243 | -836 | -93 | -2326 | -1794 | -3700 | -1392 | -2039 | -3389 | -1698 | -3474 | -2615 | -886 | -1211 | 1816 | -2162 | 352 | 3080 | -1366 | -3746 | -3163 | 269 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 244 | -1184 | -4148 | -6981 | -6387 | -1813 | -6444 | -5279 | -2010 | -6105 | 3019 | 2579 | -6214 | -5880 | -5098 | -5677 | -5700 | -1428 | -2745 | -4172 | -4275 | 270 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 245 | -1020 | -2014 | -3864 | -3270 | -2004 | -3515 | -2414 | -1547 | -2980 | 1507 | 2096 | 636 | 366 | -2705 | -2977 | 2053 | -1046 | -363 | -2485 | -2128 | 271 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 246 | -2069 | -1896 | -4408 | -3773 | 281 | -3616 | -2485 | -493 | -3369 | 995 | 3825 | -3260 | -663 | -2992 | -3171 | -1035 | 372 | -1308 | 3429 | -240 | 272 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| XT | -8455 | -4 | -1000 | -1000 | -8455 | -4 | -8455 | -4 | | | | | | | | | | | | | |
| NULT | -4 | -8455 | | | | | | | | | | | | | | | | | | | |
| NULE | 595 | -1558 | 85 | 338 | -294 | 453 | -1158 | 197 | 249 | 902 | -1085 | -142 | -21 | -313 | 45 | 531 | 201 | 384 | -1998 | -644 | |
| HMM | A | C | D | E | F | G | H | I | K | L | M | N | P | Q | R | S | T | V | W | Y | |
| 247 | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 247 | 826 | -3476 | -5131 | -4529 | -6095 | 3602 | -5206 | -5975 | -5789 | -6195 | -5270 | -4344 | -4497 | -5255 | -5574 | -3119 | -3346 | -4687 | -6176 | -6199 | 273 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 248 | -6970 | -6153 | -6729 | -6584 | -7461 | -6082 | -5807 | -8068 | 4059 | -7520 | -7222 | -6515 | -6455 | -5828 | -4943 | -7177 | -6958 | -7760 | -6247 | -7071 | 274 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 249 | -873 | 1079 | -5776 | -6006 | -5825 | 2990 | -5126 | -5636 | -5701 | -5893 | -4930 | -212 | -4263 | -5186 | -5397 | 1735 | 523 | -4358 | -6047 | -5999 | 275 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 250 | 1542 | -2277 | -4881 | -4283 | -2339 | -4128 | -3089 | 1815 | -3911 | 1521 | -1514 | -3790 | -4166 | -3556 | -3737 | -733 | -780 | 1446 | -2939 | -2588 | 276 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 251 | -4845 | -4284 | -7252 | -6672 | 3152 | -6960 | -5694 | 539 | -6456 | 1931 | 906 | -6664 | -6139 | -5338 | -5997 | -6278 | -4706 | 1097 | -4367 | -4531 | 277 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 252 | -1971 | -5354 | 3059 | -727 | -5565 | -3639 | -2884 | -5445 | -1144 | -5330 | -4583 | 2612 | 1122 | -2527 | -3750 | -376 | -3578 | -4935 | -5517 | -4577 | 278 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 253 | -7065 | 6301 | -5432 | 3971 | -7597 | -5973 | -6220 | -8534 | -6864 | -7966 | -7842 | -6103 | -6452 | -6480 | -6846 | -7141 | -7219 | -8140 | -6459 | -7376 | 279 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 254 | -411 | -3316 | -1690 | 1383 | -3637 | -1391 | 1016 | -3388 | 418 | -3332 | 62 | -44 | -2910 | 1471 | 606 | 984 | 1557 | -2938 | -3499 | -2817 | 280 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 255 | -1041 | -227 | -320 | -1158 | -3595 | -2825 | 3447 | -3337 | -507 | -107 | -2381 | 1617 | -2918 | 1232 | -1577 | 1053 | 69 | -2903 | -3479 | -2805 | 281 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 256 | 192 | -3308 | -549 | 642 | -2093 | -2838 | -1505 | -3358 | -1094 | -3319 | -2403 | -1210 | 3279 | -1050 | -28 | 324 | -1343 | -2924 | -3501 | -1377 | 282 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 257 | -951 | -153 | -2018 | -1465 | -1003 | 1296 | 2330 | -2601 | -1362 | -878 | 281 | 1830 | -3057 | 1451 | 204 | -337 | -1832 | -2348 | -3128 | 1181 | 283 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |
| 258 | -6230 | -5137 | -6592 | -6954 | 3971 | -6476 | -2652 | -5112 | -6509 | -4413 | -4512 | -5081 | -6329 | -5223 | -5868 | -5725 | -6078 | -5269 | 2517 | 3059 | 284 |
|  | -149 | -500 | 233 | -894 | -381 | 399 | 106 | -626 | 210 | -466 | -720 | 275 | 394 | 45 | 96 | 359 | 117 | -369 | -294 | -249 | |
|  | -3 | -9550 | -10592 | | -1115 | -701 | -1378 | * | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4   -1000  -1000     -4  -8455     -4  -8455     -4    902  -1085   -142    -21   -313     45    531    201    384  -1998   -644
NULT      -4   -8455
NULE     595   -1558
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| HMM | | | | | | | | | | | | | | | | | | | | | |
| | -3 | -9550 | -10592 | -894 | -1115 | -701 | -1378 | | | | | | | | | | | | | | |
| 259 | 911 | -2023 | -4568 | -3940 | -1992 | -3788 | -2674 | 2132 | -3544 | 774 | 1818 | -3434 | -3829 | -3170 | -3350 | -2878 | 339 | 1541 | -2530 | 239 | 285 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 260 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 286 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 261 | -2623 | -2441 | -5057 | -4504 | -2610 | -999 | -3375 | 2409 | -4149 | -1250 | -1757 | -3980 | -4328 | -3808 | -3992 | -1754 | 2853 | 988 | -3242 | -2888 | 287 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 262 | -6235 | -5152 | -6598 | -6959 | 1041 | -6461 | -2688 | -5132 | -6524 | -4432 | -4532 | -5109 | -6332 | -5251 | -5886 | -5746 | -6091 | -5291 | -1935 | 4799 | 288 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 263 | 1571 | -2667 | 1056 | -1648 | -2772 | -3050 | -1767 | -277 | -1537 | -2592 | -1831 | 1396 | -3138 | -1461 | -1960 | 1566 | 183 | 155 | -3013 | -413 | 289 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 264 | 278 | -3309 | -5537 | -5899 | -5999 | 3635 | -5237 | -5851 | -5877 | -6093 | -5136 | -4331 | -978 | -5317 | -5556 | -2957 | -3182 | -4530 | -6156 | -6168 | 290 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 265 | 2101 | -3312 | 909 | 502 | -3629 | 571 | -1483 | -667 | 738 | -3327 | -2403 | -358 | -2916 | -1024 | -1572 | 369 | -1453 | -1436 | -3498 | -2818 | 291 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 266 | 2474 | -1920 | -1503 | -3536 | -46 | -469 | -2432 | 870 | -3183 | 380 | -1121 | -1486 | -1544 | -2851 | -3069 | -1452 | -794 | 619 | -2374 | -2026 | 292 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -32 | -5546 | -10592 | -301 | -2408 | -701 | -1378 | | * | | | | | | | | | | | | |
| 267 | 940 | -3384 | -4043 | -1555 | -5926 | -3522 | -4705 | -5769 | -5171 | -5978 | -5062 | -3830 | -4307 | -4624 | -5229 | 3465 | -3180 | -4526 | -6109 | -5888 | 294 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 268 | 1107 | -3316 | 1180 | 1599 | -3181 | -1993 | 760 | -3388 | -274 | -3332 | -2405 | -1452 | -149 | 606 | 219 | 841 | 187 | -2302 | -3499 | -2817 | 295 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 269 | 217 | 662 | 1204 | 1555 | -3617 | -65 | -1481 | -1370 | -22 | -2071 | -2394 | -1459 | 2376 | -515 | -1571 | -702 | -1785 | -2921 | -3490 | -2811 | 296 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |
| 270 | 603 | -3315 | 664 | 269 | -1112 | -1083 | 126 | -3386 | -1 | -1799 | -2404 | 927 | 398 | 855 | -750 | 860 | -167 | -1439 | -3499 | 1485 | 297 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4  -8455     -4  -8455     -4  -8455     -4
NULT      -4  -8455
NULE     595  -1558     85    338   -294    453  -1158     -4    249    902  -1085   -142    -21   -313     45    531    201    384  -1998   -644
HMM        A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 271 | -1381 | -2813 | -5640 | -5127 | -3119 | -5045 | -4203 | 1362 | -4841 | 664 | -2125 | -4710 | -5010 | -4557 | -4742 | -2541 | 540 | -3072 | -3985 | -3601 | 298 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 272 | -2581 | 686 | -2767 | -2090 | -1463 | -3554 | -2021 | -3357 | 2221 | -1714 | -2639 | -2277 | -3603 | 585 | 3132 | -2559 | -1027 | -3099 | -3650 | -573 | 299 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 273 | 374 | -3318 | 1400 | 1763 | -3639 | -2818 | -107 | -3390 | 1273 | -3334 | -2407 | 890 | -2911 | 1294 | -371 | 73 | -928 | -2940 | -3501 | -2818 | 300 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 274 | 1677 | -499 | -4359 | -3726 | -146 | -3603 | 957 | 88 | -3331 | 194 | -287 | -3233 | -3653 | -614 | 1314 | -2685 | -844 | 584 | -2350 | 2261 | 301 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 275 | -3861 | 401 | -6555 | -6239 | -4050 | -6401 | -6447 | 3335 | -6213 | -2806 | 589 | -6058 | -6136 | -6178 | -6390 | -5781 | -3852 | 2341 | -5814 | -5285 | 302 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 276 | -997 | -5914 | 1946 | 3305 | -6053 | -3757 | -3147 | -6008 | -355 | -5854 | -5225 | 200 | -4315 | -2825 | -4383 | -3549 | -3997 | -5464 | -6052 | -4977 | 303 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 277 | -975 | 87 | 879 | 1415 | -3657 | 254 | 152 | -3408 | -588 | -3352 | -2426 | 2464 | -2925 | 1765 | -1584 | -82 | -1801 | -2958 | -3520 | -2835 | 304 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 278 | 2791 | 337 | -5913 | -6176 | -5634 | -3462 | -5126 | -5343 | -5793 | -5672 | -4761 | -4279 | -4266 | -5246 | -5422 | -2292 | -665 | -594 | -5905 | -5836 | 305 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 279 | -1658 | -5883 | 3903 | -130 | -6247 | -3788 | -3286 | -6237 | -3720 | -6082 | -5511 | -2412 | 342 | -2982 | -4729 | -3635 | -1287 | -5629 | -6288 | -5166 | 306 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 280 | 1101 | 3805 | -4419 | -3785 | 975 | -3629 | -2502 | -483 | -3382 | -734 | -687 | -3273 | -3678 | -3007 | -741 | -2714 | 578 | 1848 | -2369 | -2026 | 307 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 281 | -1656 | 887 | -4944 | -4348 | -2394 | -4209 | -3163 | 2406 | -3980 | 1724 | -1559 | -3862 | -4234 | -3629 | -3809 | -1514 | -79 | 1636 | -3007 | -2653 | 308 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 282 | -4289 | -3745 | -6903 | -6503 | -3226 | -6748 | -6224 | 3165 | -6423 | 1629 | -387 | -6422 | -6208 | -5816 | -6305 | -6131 | -4240 | 1281 | -5048 | -4991 | 309 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 283 | -1916 | 2920 | -2174 | -1619 | -2780 | -89 | 159 | -2393 | -271 | -500 | 1182 | 1633 | -3123 | -1432 | -1931 | 1312 | 1552 | -2179 | -3014 | -2501 | 310 |

TABLE Z-continued

```
HMMER2.0 [2.2 g]
NAME   sel_kivd
LENG   562
ALPH   Amino
RF     no
CS     no
MAP    yes
COM    hmmbuild -n sel_kivd sel_kivd.hmm sel_kivd.aln.fa
NSEQ   170
DATE   Wed Apr. 25 16:17:47 2012
CKSUM  3974
XT     -8455    -4   -8455    -4   -8455  -1000  -1000  -8455    -4  -8455    -4
NULT     -4   -8455
NULE    595  -1558   85    338  -294   453  -1158   197   249   902  -1085  -142   -21  -313    45   531   201   384  -1998  -644
HMM       A      C    D      E     F     G     H      I     K     L     M     N     P     Q     R     S     T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | | | | | | | | | | | | | | |
| 284 | 564 | -2845 | -5687 | -5174 | 913 | -5123 | -4264 | 2749 | -4894 | -668 | -2122 | -4772 | -3064 | -4607 | -4796 | -4292 | -820 | 2228 | -4028 | -3647 | 311 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 285 | -4367 | -4772 | -4993 | -5379 | -6814 | -3794 | -5649 | -7165 | -6214 | -7111 | -6453 | -558 | -5482 | -5753 | -6195 | -4572 | -4792 | -6082 | -6315 | -6679 | 312 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 286 | 1372 | -2567 | -5041 | -4660 | -3101 | -1348 | -3550 | -2424 | -4300 | -1150 | -2316 | -3799 | -731 | -3918 | -4116 | -2826 | 843 | 3068 | -3598 | -3278 | 313 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 287 | -2187 | -3542 | -832 | -1507 | -3888 | -3136 | -1708 | -3586 | 2345 | -940 | -2641 | -805 | -3213 | 1327 | 2536 | -2077 | -2107 | -417 | 1638 | -3074 | 314 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 288 | -5078 | -4474 | -7160 | -6720 | 3570 | -6878 | -4562 | -766 | -6448 | 1849 | 301 | -6279 | -6146 | -5256 | -5923 | -6168 | -4919 | -3065 | -3545 | 1577 | 315 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 289 | -1744 | -3249 | -6310 | -6036 | -4033 | -5420 | -5761 | 986 | -5903 | -2939 | -2797 | -5498 | -5599 | -5745 | -5934 | -4759 | 3494 | 1497 | -5466 | -5007 | 316 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 290 | -4158 | -6242 | 4095 | -546 | -6365 | -3843 | -3327 | -6042 | -3806 | -6215 | -5696 | -1885 | -4450 | -3029 | -4871 | -3747 | -4273 | -5821 | -6394 | -5239 | 317 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 291 | -2070 | -1922 | -4254 | -3630 | -468 | -3600 | -2466 | -695 | -3261 | -1079 | 1424 | -118 | -3652 | -2915 | -3119 | 1722 | 2829 | 54 | -2381 | -2035 | 318 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 292 | 821 | -1930 | -4227 | -3608 | -1895 | -891 | -2467 | 2192 | -3245 | 283 | -1138 | 506 | -3648 | -2904 | -3113 | 206 | 1066 | 834 | -2393 | -2047 | 319 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 293 | -2668 | -3276 | -5605 | -5952 | -5919 | -3542 | -5207 | -5786 | -5804 | -6039 | -5089 | -4315 | -4352 | -5291 | -5481 | 960 | 3838 | -4484 | -6108 | -6067 | 320 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 294 | 2880 | -3177 | -5884 | -6221 | -5901 | 2240 | -5227 | -5724 | -5894 | -5986 | -5010 | -4292 | -4276 | -5322 | -5506 | -117 | -803 | -4042 | -6123 | -6108 | 321 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 295 | -792 | -1903 | -4289 | -3661 | 642 | 2923 | -2459 | -951 | -1279 | -383 | 65 | -3202 | -3645 | -2926 | -3122 | -37 | -1999 | -60 | -2358 | 200 | 322 |
| | -149 | -500 | 233 | 43 | -381 | 399 | 106 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455    -4
NULT     -4 -8455
NULE    595  -1558  -100  -1000  -1000  -1000  -8455   -4  -8455  -1158   -4  -1085   -142  -21   -313   45   531   201   384  -1998  -644
HMM       A      C     D      E      F      G      H     I      K      L      M     N      P      Q    R     S    T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 296 | -6244 | -5180 | -10592 | -6970 | 4536 | -6435 | -2762 | -5155 | -6554 | -4451 | -4554 | -5167 | -6339 | -5306 | -5923 | -5789 | -6115 | -5326 | -2010 | -108 | 323 |
|  | -149 | -500 | -6612 | -894 | -381 | 399 | 106 | -626 | 210 | -466 | -720 | 275 | 394 | 45 | 96 | 359 | 117 | -369 | -294 | -249 | |
|  | -3 | -9550 | 233 | -894 | -1115 | -701 | -1378 | * | * | | | | | | | | | | | | |
| 297 | -2709 | -3368 | -4408 | -4413 | -5703 | -3547 | -4241 | -5468 | -3824 | -5593 | -4708 | -951 | -4265 | -4032 | -4346 | 2835 | 2650 | -4395 | -5693 | -5486 | 324 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 298 | -1590 | -4003 | -5042 | -4704 | -164 | -5207 | 3683 | -3707 | -4354 | -3626 | -3266 | -4166 | -5214 | 3419 | -4346 | -4319 | -4107 | -1372 | -2031 | 2271 | 325 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 299 | -1007 | -3318 | 43 | -88 | -3639 | 361 | 2154 | -545 | 1262 | -3334 | -2407 | -333 | -2911 | 2444 | 1416 | -1256 | -1784 | -2940 | -3501 | -2818 | 326 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 300 | -2796 | -2580 | -5101 | -4514 | 2679 | -4367 | -3125 | 2625 | -4130 | 1453 | -1399 | -993 | -4363 | -3685 | -3915 | -1538 | -2738 | -1692 | -2818 | -2341 | 327 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 301 | 112 | -309 | 2263 | -654 | -3626 | -2819 | -1478 | -2196 | 506 | -2422 | -1272 | 859 | 1275 | -1020 | -1567 | 50 | 1375 | -2929 | -3494 | -2814 | 328 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 302 | 189 | -158 | 214 | 107 | -3629 | -2818 | -1477 | 787 | 969 | -2703 | -453 | -702 | 1571 | 1092 | 687 | -977 | 902 | -2931 | -3495 | -2814 | 329 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 303 | 1004 | -3317 | 1862 | 1925 | -3637 | -1725 | -1477 | -3387 | -482 | -1441 | -2406 | 907 | -1114 | -1018 | -694 | 269 | -1784 | -1323 | -3500 | -2818 | 330 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 304 | -848 | -3317 | 726 | -601 | -3638 | -1747 | -211 | -3388 | 1710 | -333 | -2406 | 1661 | -1114 | 1774 | 1675 | -377 | -1782 | -1440 | -3500 | -2817 | 331 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 305 | -2061 | -2331 | -4385 | -3751 | -81 | -2263 | -2476 | -727 | -3350 | -388 | 1592 | 93 | -3656 | 359 | -3158 | -2690 | 2045 | 1937 | -2348 | 291 | 332 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 306 | -3867 | -3392 | -6454 | -6049 | -1237 | -6150 | -5473 | 3598 | -5904 | -758 | -2249 | -5789 | -5877 | -5564 | -5867 | -5440 | -3835 | 1567 | -4818 | -1105 | 333 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |
| 307 | -2074 | -3552 | 2839 | 1924 | -3858 | -2961 | 520 | -3612 | -1309 | -3562 | 1958 | -232 | -3098 | -1237 | -1831 | -366 | -807 | -3168 | -3739 | -979 | 334 |
|  | -149 | -500 | 233 | 43 | -381 | 399 | 106 | -626 | 210 | -466 | -720 | 275 | 394 | 45 | 96 | 359 | 117 | -369 | -294 | -249 | |
|  | -3 | -9550 | -10592 | -894 | -1115 | -701 | -1378 | * | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT      -8455     -4   -8455     -4   -1000     -4
NULT    -4      -8455
NULE   595  -1558  85  338  -294  -8455  453  -4  -1158  -8455  -4  197  249  902  -1085  -142  -21  -313  45  531  201  384  -1998  -644
HMM     A      C     D    E     F      G     H    I     K     L     M      N     P     Q     R    S    T    V     W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 308 | −1518 | −3380 | −6459 | −6049 | −424 | −6156 | −5626 | 3261 | −5910 | 1046 | −2242 | −5813 | −5881 | −5585 | −5884 | −5449 | −3824 | 1463 | −4979 | −4685 | 335 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 309 | −508 | −3405 | −908 | −1211 | −3730 | 995 | 2701 | −3477 | −56 | −3417 | −2496 | 1605 | −2987 | 2778 | 210 | −1812 | −1873 | −3030 | −3580 | −2902 | 336 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 310 | −1852 | −3217 | −461 | −1194 | −3494 | −1352 | 2085 | −926 | −1105 | −964 | −2317 | −413 | 2944 | 999 | 481 | −932 | −866 | −1795 | −3427 | −658 | 337 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 311 | −1845 | −3306 | 383 | 546 | 1790 | −2820 | 2882 | −3370 | −596 | −3320 | −2397 | 926 | −2913 | 569 | −303 | −1727 | −65 | −2926 | 226 | 2201 | 338 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 312 | 670 | −3302 | 427 | 753 | −518 | −1028 | 1571 | −1286 | −1062 | −1270 | −2393 | 565 | −2913 | 1385 | −195 | 291 | 721 | −1425 | −3489 | 466 | 339 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 313 | 1627 | 459 | −4403 | −3768 | 1296 | −1137 | −2485 | 245 | −3365 | 183 | −1097 | −3256 | −3663 | −2990 | −3168 | 1074 | −1000 | 1613 | −2353 | −2011 | 340 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 314 | −1864 | 543 | −1795 | −1245 | −3385 | −2870 | −1537 | −1803 | 2267 | −3122 | −36 | 580 | −2961 | −384 | 2137 | 906 | −690 | −1120 | −3370 | −577 | 341 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 315 | −269 | −2686 | −5434 | −4878 | −1053 | −4793 | −3824 | 2508 | −4555 | 314 | 1042 | −4441 | −4760 | −4218 | −4413 | −3933 | −1375 | 2521 | −3603 | −3252 | 342 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 316 | 1002 | −3281 | 239 | −655 | 102 | 2322 | −1487 | −580 | −46 | −3290 | −1597 | 1008 | −1011 | −151 | −1578 | −1734 | −862 | −2894 | −3474 | −2801 | 343 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 317 | −1044 | −4326 | 2472 | 679 | −3647 | 1226 | 729 | −3398 | −699 | −3342 | −2415 | 867 | −2917 | 266 | −6 | −157 | −447 | −2948 | −3509 | −2826 | 344 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 318 | −229 | −3316 | −1693 | 436 | −3637 | −2819 | 291 | −3387 | 1725 | −3332 | −2406 | −454 | −2912 | 2108 | 193 | −635 | 1704 | −18 | −3500 | −2818 | 346 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −36 | −5365 | −10592 | −275 | −2525 | −701 | −1378 | * | * | | | | | | | | | | | | |
| 319 | −666 | −492 | −1067 | −2114 | −1045 | −3226 | −1977 | 909 | 704 | −1292 | −1502 | 60 | −2106 | 405 | −722 | −961 | 1049 | 1623 | 2972 | −806 | 347 |
|  | −149 | −500 | 233 | 43 | −381 | 399 | 106 | −626 | 210 | −466 | −720 | 275 | 394 | 45 | 96 | 359 | 117 | −369 | −294 | −249 | |
|  | −3 | −9550 | −10592 | −894 | −1115 | −701 | −1378 | * | * | | | | | | | | | | | | |
| 320 | −630 | −1913 | −1273 | −3600 | 3438 | −3585 | −2446 | 50 | −3234 | −1762 | 54 | −683 | −3637 | −2891 | −3098 | −1587 | −1361 | −848 | −2366 | 2790 | 348 |

TABLE Z-continued

| HMMER2.0 | [2.2 g] |
|---|---|
| NAME | sel_kivd |
| LENG | 562 |
| ALPH | Amino |
| RF | no |
| CS | no |
| MAP | yes |
| COM | hmmbuild -n sel_kivd sel_kivd.hmm sel_kivd.aln.fa |
| NSEQ | 170 |
| DATE | Wed Apr. 25 16:17:47 2012 |
| CKSUM | 3974 |
| XT | -8455 -4 -1000 -1000 -8455 -4 -8455 -4 |
| NULT | -4 -8455 |
| NULE | 595 -1558 85 338 -294 453 -1158 197 249 902 -1085 -142 -21 -313 45 531 201 384 -1998 -644 |
| HMM | A C D E F G H I K L M N P Q R S T V W Y |

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 321 | 1199 | -3312 | -362 | 544 | -3631 | -178 | -1478 | -3380 | -1060 | -3327 | -2402 | 738 | 1276 | -236 | -1567 | 1104 | 1043 | -1066 | -3497 | -727 | 349 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -45 | -9550 | -5105 | -894 | -1115 | -701 | -1378 | * | | | | | | | | | | | | | |
| 322 | -308 | -4084 | 587 | 108 | -4380 | 1660 | -2069 | -4163 | -1802 | -4093 | -3209 | 461 | 2505 | 1772 | -2371 | -1264 | -2491 | -3698 | -4266 | -3516 | 350 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9508 | -10550 | -894 | -1115 | -462 | -1868 | * | | | | | | | | | | | | | |
| 323 | -1953 | -3366 | -6460 | -6062 | 29 | -6175 | -5701 | 2797 | -5936 | 1043 | -2312 | -5830 | -5906 | -5649 | -5934 | -5476 | -3817 | 2327 | -5069 | -4746 | 351 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 324 | 701 | -3248 | -99 | 834 | -3539 | -2836 | -1498 | -3268 | -1091 | -1842 | -2346 | 248 | 2031 | -1049 | -1593 | 970 | 951 | -123 | -3451 | -524 | 352 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 325 | -1410 | -3260 | -5921 | -5299 | -184 | -5253 | -4088 | 778 | -4945 | 1397 | 4400 | -4914 | -5049 | -4326 | -4669 | -4388 | -482 | -2158 | -3550 | -3409 | 353 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 326 | 1285 | -3315 | -260 | 721 | -3635 | 258 | -1476 | -962 | 1063 | -1269 | -2404 | -194 | 688 | 423 | 612 | -204 | -1782 | -747 | -3498 | -2816 | 354 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 327 | 494 | -3316 | 2832 | 717 | -3637 | -1309 | -527 | -3387 | -766 | -3332 | -293 | -863 | -2910 | 1379 | -298 | -72 | -1279 | -1790 | -3499 | -2817 | 355 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 328 | 2576 | -2180 | -4731 | -4107 | -1084 | -3965 | -2855 | -848 | -3717 | 1283 | -275 | -3612 | -3990 | -3329 | -3521 | -1720 | -2319 | 1410 | -2685 | -2357 | 356 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 329 | -4546 | -3981 | -7101 | -6645 | -2951 | -6937 | -6119 | 1480 | -6530 | -2638 | -366 | -6626 | -6239 | -5665 | -6259 | -6322 | -4467 | 1758 | -4785 | -4864 | 357 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 330 | 768 | -3316 | 878 | 1060 | -3637 | -2817 | 826 | -1505 | 1346 | -3238 | -2405 | 174 | -2910 | 1702 | -1081 | 367 | 24 | -1011 | -3499 | -2816 | 358 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 331 | 2281 | -3237 | -1732 | 415 | -3523 | 419 | 220 | -376 | -431 | -3238 | -2335 | -1487 | -2930 | 609 | -790 | -667 | 634 | -418 | -3441 | -1922 | 359 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 332 | -5028 | -4411 | -7472 | -6930 | -2665 | -7297 | -6081 | -1235 | -6765 | 3214 | -1426 | -7047 | -6323 | -5536 | -6268 | -6718 | -4890 | 317 | -4529 | -4745 | 360 |
| | -149 | -500 | 233 | 43 | -381 | 399 | 106 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455    -4
NULT     -4 -8455
NULE    595 -1558  85  338 -294  453 -1158 197  249  902 -1085 -142  -21 -313   45  531  201  384 -1998 -644
HMM      A     C    D    E    F    G    H    I    K    L    M    N    P    Q    R    S    T    V    W    Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -265 | -9550 | -2586 | -894 | -1115 | -701 | -1378 | * | * | -28 | -117 | 538 | -2719 | -244 | 259 | 944 | 268 | -853 | -3259 | -1366 | 361 |
| 333 | 568 | -3075 | -494 | 429 | -3377 | -2627 | 2895 | -2705 | -875 | -466 | -720 | 275 | 394 | 45 | 96 | 359 | 117 | -369 | -294 | -249 | |
| | -149 | -500 | 233 | 43 | -381 | -2450 | 106 | -626 | 210 | | | | | | | | | | | | |
| | -2418 | -9288 | -302 | -894 | -1115 | -2450 | -292 | | | | | | | | | | | | | | |
| 334 | -777 | -2314 | 2263 | 367 | -2610 | -1352 | -308 | -2393 | -92 | -2339 | -1481 | 900 | -1641 | 1579 | -673 | 1108 | -758 | -1939 | -2526 | -1767 | 362 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -2052 | -7930 | -406 | -72 | -4366 | -4400 | -70 | | | | | | | | | | | | | | |
| 335 | -1817 | -1401 | -4122 | -3669 | -818 | -3836 | -2960 | 3166 | -3384 | 1220 | 314 | -3462 | -3558 | -2957 | -3280 | -3105 | -1773 | 784 | -2289 | -2053 | 364 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -2052 | -406 | -7930 | -72 | -4366 | -4400 | -70 | | | | | | | | | | | | | | |
| 336 | -1425 | -2343 | -1566 | -736 | -2851 | -2127 | 3928 | -2415 | 1528 | -2219 | -1486 | -804 | -2140 | 118 | -1794 | -1322 | -1224 | -2137 | -2168 | -1869 | 366 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -18 | -6888 | -7930 | -894 | -1115 | -779 | -1262 | * | | | | | | | | | | | | | |
| 337 | -585 | -2852 | -357 | 1803 | -3173 | -2352 | -1011 | -2924 | 193 | -2868 | -1942 | -459 | 560 | 1915 | 1554 | -358 | 423 | -2474 | -3036 | -2353 | 367 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -4 | -8921 | -9963 | -894 | -1115 | -499 | -1775 | | | | | | | | | | | | | | |
| 338 | -658 | -2338 | 374 | -477 | -2387 | -3029 | -1759 | 995 | 356 | 1590 | 197 | 1348 | -3107 | -1542 | -2011 | -1493 | -696 | -56 | -2712 | -2250 | 368 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9403 | -10445 | -894 | -1115 | -1951 | -432 | | | | | | | | | | | | | | |
| 339 | 651 | 2565 | -304 | 391 | 311 | -807 | -1432 | -2906 | 113 | 47 | -71 | -914 | -945 | -1008 | 126 | -92 | 1163 | -1212 | -3224 | -1155 | 369 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9403 | -10445 | -894 | -1115 | -788 | -1249 | * | | | | | | | | | | | | | |
| 340 | 855 | -3195 | -410 | 1066 | -3484 | -1895 | -1447 | 796 | 432 | 381 | 1071 | -1026 | -1154 | 405 | -36 | -1162 | 335 | -400 | -3398 | -2734 | 370 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -35 | -9486 | -5454 | -894 | -1115 | -392 | -2070 | | | | | | | | | | | | | | |
| 341 | -36 | -3292 | 1417 | 918 | -3613 | -1554 | 526 | -2214 | 677 | -3308 | -2381 | -514 | 99 | 684 | 482 | 952 | 910 | -2914 | -3475 | -2793 | 371 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -149 | -500 | -10561 | -894 | -1115 | -1081 | -923 | * | | | | | | | | | | | | | |
| 342 | -244 | 1040 | -1072 | -1204 | 466 | -486 | 823 | -1937 | -1882 | 1653 | -319 | -2160 | -456 | -1120 | 624 | -1285 | -1876 | -1790 | -2723 | 2228 | 372 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -33 | -9519 | -5562 | -894 | -1115 | -1081 | -923 | | | | | | | | | | | | | | |
| 343 | 701 | -703 | 642 | -128 | -3586 | 722 | 952 | -742 | 1116 | -3282 | -853 | 556 | -2863 | 323 | 124 | 82 | -534 | 273 | -3450 | -2768 | 373 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -107 | -9489 | -3839 | -894 | -1115 | -401 | -2044 | * | | | | | | | | | | | | | |
| 344 | 262 | -3195 | -694 | 260 | 1240 | -594 | 127 | 1133 | -707 | -2472 | -2289 | 1639 | -693 | 691 | -664 | -276 | -3 | -445 | -3390 | -1187 | 374 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9451 | -10493 | -894 | -1115 | -318 | -2337 | | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr 25 16:17:47 2012
CKSUM 3974
XT    -8455    -4  -8455    -4  -1000  -1000  -1000    -4  -8455    -4
NULT    -4  -8455
NULE   595  -1558    85    338   -294   453  -1158    -4  -1085  -142   -21  -313   45   531   201   384  -1998   -644
HMM      A      C     D      E     F     G     H     I     K     L     M     N     P     Q     R     S     T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 345 | 125 | -3316 | -619 | 969 | -3637 | -422 | 1114 | -350 | 1730 | -2129 | -2405 | 522 | -2910 | 630 | 835 | -137 | -131 | -812 | -3499 | -2816 | 375 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -- | -9550 | -4403 | -894 | -1115 | -701 | -1378 | * | * | | | | | | | | | | | | |
| 346 | 536 | -2610 | -2122 | -68 | 108 | -1068 | 105 | -2319 | -1454 | -1611 | -1764 | -438 | 1293 | -1379 | -1879 | 1204 | -172 | -552 | 3942 | -2434 | 376 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9481 | -10523 | -894 | -1115 | -379 | -2112 | * | * | | | | | | | | | | | | |
| 347 | 405 | -3229 | 744 | -505 | 418 | -2839 | 1259 | -1718 | -1098 | -465 | -2329 | -1490 | 1869 | 1360 | -353 | 333 | -267 | -2831 | -3436 | 349 | 377 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 348 | 151 | -3226 | -647 | -228 | 538 | -935 | 636 | 241 | 745 | -368 | -197 | -426 | 1304 | 477 | -386 | -1750 | 791 | -1863 | -3434 | 506 | 378 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 349 | 531 | -979 | -681 | 137 | -993 | 186 | -1528 | -3105 | -1141 | -1335 | -2259 | -1528 | 2491 | -223 | -751 | 926 | -279 | -396 | -3378 | -2740 | 379 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -25 | -9550 | -5957 | -894 | -1115 | -701 | -1378 | * | * | | | | | | | | | | | | |
| 350 | 699 | -496 | -857 | 947 | -995 | -2195 | -1516 | -269 | 197 | -1236 | -108 | -41 | -648 | 1131 | -1046 | -358 | 886 | 766 | -3348 | -71 | 380 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -220 | -9527 | -2834 | -894 | -1115 | -988 | -1012 | * | * | | | | | | | | | | | | |
| 351 | 632 | -1789 | -1615 | -2960 | 144 | -3309 | 620 | 1093 | -153 | 527 | 172 | -2732 | 398 | -2414 | -563 | 239 | -1698 | 433 | -2234 | 1925 | 381 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -30 | -9310 | -5717 | -894 | -1115 | -305 | -2393 | * | * | | | | | | | | | | | | |
| 352 | 412 | -764 | -266 | 682 | -577 | -2832 | 493 | -76 | 536 | -355 | -1251 | -685 | 989 | 256 | -1609 | 205 | 679 | 132 | -3326 | -1304 | 382 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9504 | -10547 | -894 | -1115 | -1227 | -804 | * | * | | | | | | | | | | | | |
| 353 | 731 | -3281 | -359 | 795 | -3602 | -1089 | 636 | -3353 | 84 | -3297 | -2370 | -699 | 2030 | 506 | 1324 | 237 | -882 | -1451 | -3464 | -1401 | 383 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -588 | -9504 | -1586 | -894 | -1115 | -1227 | -804 | * | * | | | | | | | | | | | | |
| 354 | 131 | -2851 | -188 | 366 | -3172 | -475 | 0 | -2922 | 682 | -1961 | -1940 | -988 | 2819 | 316 | -93 | -128 | -1318 | -2473 | -3035 | -2352 | 384 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -124 | -8921 | -3641 | -894 | -1115 | -2727 | -236 | * | * | | | | | | | | | | | | |
| 355 | 801 | -2783 | -81 | 1240 | -472 | -1325 | -966 | -2841 | 728 | -404 | -537 | -945 | -191 | 994 | 5 | -36 | 201 | -81 | -2972 | -2294 | 385 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -8852 | -1613 | -894 | -1115 | -1706 | -528 | * | * | | | | | | | | | | | | |
| 356 | 757 | -2227 | -316 | -674 | -232 | -1343 | 1335 | 575 | -284 | -422 | -46 | -25 | 166 | 894 | -1045 | 668 | 506 | -1767 | -2506 | -399 | 386 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -576 | -8582 | -9624 | -894 | -1115 | -3259 | -159 | * | * | | | | | | | | | | | | |
| 357 | 101 | -2637 | -198 | 870 | 14 | -1188 | 1496 | -2700 | 1104 | -1412 | 138 | 582 | -667 | -354 | 55 | -434 | 1227 | -651 | -2824 | -2144 | 387 |

TABLE Z-continued

| | | | | | | | | | | | | | | | | | | | | | | |
|---|---|---|---|---|---|---|---|---|---|---|---|---|---|---|---|---|---|---|---|---|---|---|
| HMMER2.0 [2.2 g] | | | | | | | | | | | | | | | | | | | | | | |
| NAME sel_kivd | | | | | | | | | | | | | | | | | | | | | | |
| LENG 562 | | | | | | | | | | | | | | | | | | | | | | |
| ALPH Amino | | | | | | | | | | | | | | | | | | | | | | |
| RF no | | | | | | | | | | | | | | | | | | | | | | |
| CS no | | | | | | | | | | | | | | | | | | | | | | |
| MAP yes | | | | | | | | | | | | | | | | | | | | | | |
| COM hmmbuild -n sel_kivd sel_kivd.hmm sel_kivd.aln.fa | | | | | | | | | | | | | | | | | | | | | | |
| NSEQ 170 | | | | | | | | | | | | | | | | | | | | | | |
| DATE Wed Apr. 25 16:17:47 2012 | | | | | | | | | | | | | | | | | | | | | | |
| CKSUM 3974 | | | | | | | | | | | | | | | | | | | | | | |
| XT    -8455   -4   -8455   -4   -8455   -4 | | | | | | | | | | | | | | | | | | | | | | |
| NULT  -4      -8455 | | | | | | | | | | | | | | | | | | | | | | |
| NULE  595 -1558 85 338 -294 453 -1158 197 249 902 -1085 -142 -21 -313 45 531 201 384 -1998 -644 | | | | | | | | | | | | | | | | | | | | | | |
| HMM   A   C   D   E   F   G   H   I   K   L   M   N   P   Q   R   S   T   V   W   Y | | | | | | | | | | | | | | | | | | | | | | |
|       | -149 | -500 | 233 | 43 | -381 | 399 | 106 | -626 | 210 | -466 | -720 | 275 | 394 | 45 | 96 | 359 | 117 | -369 | -294 | -249 | | |
| 358 | -5 | -8624 | -9667 | -894 | -1115 | -74 | -4331 | * | * | | | | | | | | | | | | | |
|     | 133 | -1714 | 754 | 1380 | -3636 | -664 | -581 | -2447 | 336 | -1337 | -2404 | 612 | 1593 | 513 | -48 | -818 | -358 | -622 | -109 | -2816 | | 388 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 359 | -3 | -9550 | -10592 | -894 | -1115 | -701 | -1378 | | | | | | | | | | | | | | | |
|     | 436 | -2977 | -705 | 602 | 725 | -2916 | -1594 | 10 | 535 | -958 | -2103 | -1623 | 1436 | 689 | -897 | -1157 | -948 | 437 | -3246 | 1547 | | 389 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 360 | -3 | -9550 | -10592 | -894 | -1115 | -701 | -1378 | * | | | | | | | | | | | | | | |
|     | 205 | -3251 | -1068 | 1390 | 820 | -1557 | 1174 | -1360 | -1087 | -97 | -2348 | -717 | 678 | 753 | 263 | -195 | 317 | -1059 | -3452 | -150 | | 390 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 361 | -3 | -9550 | -10592 | -894 | -1115 | -701 | -1378 | * | | | | | | | | | | | | | | |
|     | 267 | -2930 | -1931 | 407 | -340 | -1043 | 980 | -1173 | -640 | 61 | -2060 | 442 | 2158 | -100 | -1751 | -550 | -299 | 311 | -3209 | -668 | | 391 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 362 | -244 | -9550 | -2696 | -894 | -1115 | -701 | -1378 | * | | | | | | | | | | | | | | |
|     | 93 | -3130 | 232 | 357 | -3451 | -779 | -415 | -3201 | -213 | -3146 | -2220 | -1268 | 2376 | 1918 | -797 | 537 | -708 | -1639 | 538 | -2631 | | 392 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 363 | -743 | -9309 | -1319 | -894 | -1115 | -2374 | -309 | * | | | | | | | | | | | | | | |
|     | -6 | -2504 | 172 | 635 | -2777 | -1401 | 770 | -220 | -407 | -2499 | -387 | -797 | -50 | 1315 | -905 | 604 | 1000 | 837 | -2716 | -630 | | 393 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 364 | -6 | -8572 | -9614 | -894 | -1115 | -3240 | -161 | * | | | | | | | | | | | | | | |
|     | 328 | -2646 | 73 | 1229 | -2966 | 77 | 795 | -1751 | -51 | -2661 | -1735 | 38 | 1698 | -3 | -895 | 1071 | -622 | -2267 | -2829 | -2147 | | 394 |
|     | -149 | -500 | 233 | 43 | -381 | 399 | 106 | -626 | 210 | -466 | -720 | 275 | 394 | 45 | 96 | 359 | 117 | -369 | -294 | -249 | | |
|     | -2431 | -1634 | -1022 | -121 | -3635 | -385 | -2095 | * | | | | | | | | | | | | | | |
| 365 | 598 | -2843 | 753 | 134 | -3164 | 53 | 407 | -2914 | 1096 | -2859 | 1932 | 400 | -627 | -91 | 621 | 1087 | 733 | -2465 | -3026 | -2343 | | 397 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 366 | -4 | -8910 | -9952 | -894 | -1115 | -202 | -2937 | * | | | | | | | | | | | | | | |
|     | 369 | -3283 | 2236 | 955 | -304 | -742 | 948 | -3355 | 586 | -3299 | -2372 | 632 | -749 | 396 | -1063 | -36 | 121 | -2905 | -3467 | -1403 | | 398 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 367 | -33 | -9507 | -5550 | -894 | -1115 | -459 | -1876 | * | | | | | | | | | | | | | | |
|     | 1320 | -3296 | 1066 | 1001 | -3617 | 977 | -112 | -3367 | -526 | -3312 | -2385 | -201 | -2889 | 1749 | -1543 | -423 | 330 | -1596 | -3479 | -2796 | | 399 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 368 | -34 | -9520 | -5517 | -894 | -1115 | -513 | -1741 | * | | | | | | | | | | | | | | |
|     | 535 | -2287 | -2680 | -191 | -1076 | -919 | -1963 | -824 | 486 | -280 | 1374 | -2225 | 2628 | -1837 | -1154 | -860 | 156 | -704 | -424 | -2255 | | 400 |
|     | -149 | -500 | 233 | 43 | -381 | 399 | 106 | -626 | 210 | -466 | -720 | 275 | 394 | 45 | 96 | 359 | 117 | -369 | -294 | -249 | | |
| 369 | -3 | -9519 | -10562 | -894 | -1115 | -508 | -1751 | * | | | | | | | | | | | | | | |
|     | -4990 | -4377 | -7428 | -6876 | -749 | -7259 | -6008 | 1154 | -6710 | 3030 | -1420 | -6977 | -6295 | -5503 | -6224 | -6655 | -4849 | -26 | -4502 | -4705 | | 401 |
|     | -149 | -500 | 233 | 43 | -381 | 399 | 106 | -626 | 210 | -466 | -720 | 275 | 394 | 45 | 96 | 359 | 117 | -369 | -294 | -249 | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT       -8455     -4   -8455     -4   -8455     -4
NULT     -4     -8455
NULE    595   -1558   -85   338   -294   453  -1158    -4   197   249   902  -1085  -142   -21   -313    45   531   201   384  -1998  -644
HMM       A       C      D     E      F     G      H     I     K     L     M     N      P      Q      R     S     T     V      W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 370 | -1879 | -3300 | -10592 | -894 | -1115 | -701 | -1378 | * | * | -2111 | -2399 | 697 | -2949 | -1067 | -663 | 981 | 2931 | -1464 | -3498 | -2829 | 402 |
| | -149 | -500 | 1041 | -1190 | -3604 | -2852 | -1519 | -3340 | -340 | -1423 | -466 | -720 | 275 | 394 | 45 | 96 | 359 | 117 | -369 | -294 | -249 | |
| | -3 | -9550 | 233 | -894 | -381 | -701 | 106 | -626 | 210 | | | | | | | | | | | | | |
| 371 | -4631 | -5070 | -3965 | -3822 | -3291 | -4894 | 1160 | -5212 | -2442 | -1423 | -4417 | -3081 | -5130 | 4412 | -2463 | -4521 | -4541 | -5157 | -3728 | -2784 | 403 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 372 | 403 | 656 | 1535 | 1731 | -3638 | -2817 | 1362 | -3389 | 1026 | -3333 | -2406 | -262 | -2911 | 1509 | -58 | -274 | -1783 | -2939 | -3500 | -2817 | 404 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 373 | 290 | -3297 | 151 | -364 | -3609 | -1155 | 566 | -647 | -1065 | -3309 | 558 | 1242 | -2915 | -147 | 1886 | -604 | 1462 | -1381 | -3485 | 611 | 405 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 374 | -4550 | -3991 | -6555 | -6115 | 3483 | -6094 | -3952 | -526 | -5787 | 1486 | -1666 | -5510 | -5720 | -4903 | -5399 | -5291 | -4341 | 147 | -3162 | 2158 | 406 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 375 | -6168 | -2253 | -6583 | -6932 | 2367 | -6440 | 210 | -5091 | -6474 | -4403 | -4494 | -5081 | -6310 | -5219 | -5847 | -5699 | -6032 | -5244 | 5850 | -719 | 407 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 376 | -781 | -3317 | 345 | -260 | -3638 | -1401 | 2233 | -3388 | 996 | -3333 | -2406 | 582 | 543 | 2722 | -45 | -624 | -1782 | -2939 | -3500 | 73 | 408 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 377 | 601 | -2596 | -2257 | 217 | -2677 | -3072 | 1005 | -512 | -1582 | -992 | 2164 | -1913 | -3153 | 1887 | 1630 | -2023 | 966 | -1012 | -2945 | 164 | 409 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 378 | -4398 | -3881 | -6913 | -6419 | -642 | -6623 | -5696 | 2553 | -6243 | 807 | 3319 | -6304 | -6049 | -5441 | -5971 | -5933 | -4318 | 1767 | -4584 | -4609 | 410 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 379 | 839 | 1027 | -1737 | 649 | -3509 | -1610 | -1503 | -3233 | -1099 | -1517 | -57 | -98 | -2932 | 3122 | -277 | -55 | -1790 | -2828 | -3435 | 751 | 411 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 380 | 178 | -3318 | 1699 | -489 | -3639 | 490 | 2731 | -3390 | -70 | -3334 | -2407 | 1139 | -2911 | 147 | 1018 | -691 | -3 | -2940 | -3501 | -2819 | 412 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |
| 381 | 665 | 95 | -4424 | -3799 | 3791 | -1077 | 1059 | -1457 | -3403 | -783 | -1166 | -3290 | -3716 | -3027 | -3215 | -2749 | -2071 | -666 | -2332 | 65 | 413 |
| | -149 | -500 | 233 | -894 | -381 | -701 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455   -4   -8455   -8455   -4   -8455
NULT  -4      -8455
NULE  595 -1558 -10592 338 -294 453 -1158 197 249 902 -1085 -142 -21 -313 45 531 201 384 -1998 -644
HMM            A        C        D        E        F        G        H        I        K        L        M        N        P        Q        R        S        T        V        W        Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 382 | -4973 | -4386 | -7371 | -6793 | -875 | -7113 | -5796 | 1621 | -6587 | 2985 | -1369 | -6833 | -6212 | -5392 | -6090 | -6463 | -899 | -2622 | -4385 | -4555 | 414 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 383 | -718 | -3321 | -267 | 211 | -3643 | -1896 | 43 | -3393 | 1228 | -2312 | -2410 | -1457 | -2915 | 2595 | 2216 | -1729 | 490 | -2943 | -3503 | -2821 | 415 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 384 | 283 | -3376 | -679 | 1631 | -3693 | -1166 | -521 | -3443 | -598 | -1766 | -2468 | -1491 | 3057 | -547 | -1634 | -476 | -1845 | -2996 | -3561 | -2876 | 416 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 385 | -3601 | -5430 | 2293 | -1155 | -5635 | 2377 | -2920 | -5519 | -803 | -5396 | -4464 | 2475 | -4145 | -2567 | -1437 | -1970 | -3640 | -5009 | -5580 | -4633 | 417 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 386 | -4138 | -6262 | -3869 | -485 | -6355 | -3822 | -3301 | -6381 | -3781 | -6195 | -5674 | 1640 | -4429 | -3001 | -4853 | -3723 | -4251 | -5803 | -6396 | -5219 | 418 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 387 | -3868 | -3353 | -6562 | -6248 | -4046 | -6415 | -6467 | 2771 | -6223 | -692 | -2731 | -6070 | -6144 | -6186 | -6401 | -5797 | -835 | -2931 | -5820 | -5295 | 419 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 388 | -4103 | -3569 | -6763 | -6412 | -3548 | -6628 | -6401 | 2500 | -6368 | 1930 | -2265 | -6293 | -6206 | -6008 | -6391 | -6021 | -4075 | 2175 | -5381 | -5158 | 420 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 389 | -1854 | -3484 | -6497 | -6036 | 333 | -6136 | -5386 | 2014 | -5852 | 2206 | -1944 | -5798 | -5811 | -5360 | -5722 | -5401 | -3897 | 1893 | -4650 | -4470 | 421 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 390 | 3030 | -3151 | -5867 | -6132 | -5642 | 503 | -5119 | -5364 | -5779 | -5682 | -4769 | -4271 | -4266 | -5234 | -5417 | -1854 | 1009 | 1015 | -5910 | -5840 | 422 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 391 | -4321 | -6263 | 2878 | 3169 | -6472 | -3985 | -3485 | -6543 | -3968 | -6343 | -5837 | -2599 | -4587 | -3195 | -5010 | -3915 | -4435 | -5970 | -6403 | -5381 | 423 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 392 | -126 | -2450 | -2873 | -2327 | -2552 | -3319 | -2181 | -1382 | -2146 | -1342 | -1698 | -276 | -3444 | 3984 | -2445 | -2341 | -172 | -413 | -2931 | -2505 | 424 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 393 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 425 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 394 | -2633 | -3242 | -5534 | -5866 | -5777 | -3512 | -5127 | -4621 | -5651 | -5926 | -5012 | -4266 | -4320 | -5208 | -5358 | -1912 | -4033 | -4404 | -6021 | -5883 | 426 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455  -4  -8455  -4  -8455  -4
NULT  -4  -8455
NULE  595 -1558 85 338 -294 -8455 453 -1158 197 249 902 -1085 -142 -21 -313 45 531 201 384 -1998 -644
HMM        A       C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -149 | -500 | 233 | 43 | -381 | 399 | 106 | -626 | 210 | -466 | -720 | 275 | 394 | 45 | 96 | 359 | 117 | -369 | -294 | -249 | |
| | -149 | -9550 | -10592 | -894 | -1115 | -701 | -1378 | * | * | | | | | | | | | | | | |
| 395 | 1763 | 1191 | -5942 | -6273 | -5887 | -3460 | -5231 | -5706 | -5900 | -5971 | -4997 | -4300 | 431 | -5332 | -5504 | 3077 | -3046 | -4387 | -6111 | -6096 | 427 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 396 | 1173 | 1989 | -3754 | -3157 | 3016 | -979 | 492 | -1519 | -2879 | -1085 | -1204 | 430 | -3572 | -2616 | -2901 | 318 | -1993 | -1428 | -2436 | 980 | 428 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 397 | -53 | -2388 | -4783 | -4246 | 3995 | -3925 | -2682 | -506 | -3857 | -2282 | -1673 | -3619 | -4065 | -3443 | -3657 | -615 | -1216 | -1872 | -2399 | 1378 | 429 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 398 | 145 | -3184 | -5785 | -6136 | -5912 | 3603 | -5218 | -5738 | -5885 | -5998 | -5022 | -4280 | -4279 | -5309 | -5507 | -1463 | -576 | -4403 | -6132 | -6115 | 430 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 399 | 2534 | -1986 | -4112 | -3812 | -1952 | -3658 | -2585 | 529 | -3425 | 897 | 1819 | -3317 | -3731 | -3059 | -3250 | 610 | -1392 | -1362 | -2471 | -2130 | 431 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 400 | 2407 | 456 | -4316 | -3692 | -1885 | -220 | -2486 | -406 | -3311 | -1779 | 345 | -3221 | -3657 | -2954 | -3149 | 1254 | -1819 | 35 | -2386 | 1790 | 432 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 401 | 1448 | -3306 | 1885 | -29 | -3622 | 141 | -1478 | -1331 | -454 | -834 | -2396 | -411 | -555 | -369 | -1567 | 183 | -858 | -1997 | -3492 | -2812 | 433 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 402 | -1088 | -2049 | -4563 | -3929 | -1930 | -3788 | 2034 | 1160 | -3530 | 2211 | 2299 | -3429 | -3822 | -469 | -3332 | -2875 | -2169 | 481 | -2500 | -2172 | 434 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 403 | 356 | -3285 | -1709 | -1160 | -577 | -2098 | 132 | -1707 | 535 | -3295 | -2378 | -962 | 1288 | -340 | 2765 | 313 | -478 | -2899 | -3477 | -2803 | 435 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 404 | -5304 | -4636 | -7665 | -7057 | 698 | -7536 | -6043 | -815 | -6875 | 3109 | 1688 | -7277 | -6363 | -5472 | -6265 | -6968 | -5114 | -2978 | -4417 | -4682 | 436 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 405 | -2170 | -4497 | -3510 | -3299 | -3769 | -4347 | -1223 | -4924 | 375 | -4729 | -4142 | -3306 | 3936 | -2707 | -2021 | -3808 | -3825 | -4618 | -3974 | 1346 | 437 |
| | -149 | -500 | 233 | -894 | -1115 | -701 | -1378 | -626 | 210 | -466 | -720 | 275 | 394 | 45 | 96 | 359 | 117 | -369 | -294 | -249 | |
| | -3 | -9550 | -10592 | | | | | * | | | | | | | | | | | | | |
| 406 | 761 | -1334 | 68 | 978 | -3637 | -2817 | 809 | -3388 | 1616 | -3332 | -2405 | 572 | -751 | 1393 | -940 | 880 | -789 | -1062 | -3499 | -2817 | 438 |
| | -149 | -500 | 233 | -894 | -1115 | -701 | -1378 | -626 | 210 | -466 | -720 | 275 | 394 | 45 | 96 | 359 | 117 | -369 | -294 | -249 | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455    -4  -8455    -4 -8455    -4
NULT      -4 -8455
NULE     595 -1558 -10592  338  -294  453 -1158  -4  249  902 -1085 -142  -21 -313   45  531  201  384 -1998  -644
HMM        A     C      D    E     F    G     H   I    K    L     M    N    P    Q    R    S    T    V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | | | | | | | | | | | | | | | | | | | | | |
| 407 | -2667 | -4244 | -10592 | -894 | -1115 | -701 | -1378 | * | -915 | -4245 | -3370 | 1538 | -3544 | -1769 | -1357 | -2115 | -493 | -3853 | -4418 | -3658 | 439 |
| — | -149 | -500 | 1961 | -744 | -4531 | 2730 | -854 | -4318 | 210 | -466 | -720 | 275 | 394 | 45 | 96 | 359 | 117 | -369 | -294 | -249 | |
| — | -3 | -9550 | 233 | -894 | -381 | 399 | 106 | -626 | | | | | | | | | | | | | |
| 408 | 1466 | 3113 | -4382 | -3829 | -2304 | -3540 | -2788 | -1834 | -3490 | -2196 | 1011 | 866 | -3766 | -3161 | -3389 | -329 | 935 | 1966 | -2791 | -2449 | 440 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 409 | -1171 | -3316 | 412 | -140 | -3637 | -2817 | 976 | -1458 | 861 | -3332 | -2405 | 473 | -2910 | 1316 | 215 | 129 | 2374 | -1381 | -3499 | -2816 | 441 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 410 | -2304 | -451 | -4627 | -4007 | 3602 | -3848 | -2618 | -1533 | -3605 | 432 | 672 | -3475 | -3883 | -3202 | -3396 | -2010 | -2243 | 370 | -2405 | 2139 | 442 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 411 | -3907 | -3414 | -6533 | -6152 | -3546 | -6287 | -5839 | 3217 | -6046 | 595 | -2331 | -5939 | -5988 | -5757 | -6057 | -5610 | -3881 | 2023 | -5133 | 82 | 443 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 412 | 790 | 1969 | -4777 | -4348 | -2968 | 2486 | -3348 | -785 | -4017 | -2826 | -2194 | 448 | -3951 | -3670 | -3899 | -807 | -2489 | 1776 | -3442 | -3115 | 444 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 413 | -1507 | -3497 | -3894 | -4200 | -5869 | -3595 | -4454 | -5770 | -4397 | -5909 | -5041 | -3759 | -4351 | 4478 | -4459 | -959 | -3263 | -4597 | -5954 | -5675 | 445 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 414 | -2565 | -3197 | -4765 | -4794 | -5469 | -1282 | -4553 | -5224 | -4762 | -5456 | -4558 | -3914 | 3884 | -280 | -4789 | 395 | 6 | -1383 | -5678 | -5465 | 446 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 415 | -3978 | -3624 | -6358 | -5756 | -2482 | -5738 | -4608 | 878 | -5427 | 2976 | 1708 | -5437 | -5425 | -4697 | -5115 | -1639 | -1600 | -2294 | -3876 | -3823 | 447 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 416 | -7875 | -6321 | -7259 | -7641 | -6426 | -6309 | -6538 | -8612 | -7781 | -7895 | -7930 | -7574 | -6736 | -7627 | -7209 | -8364 | -8007 | -8416 | 6311 | -6122 | 448 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 417 | 259 | -3257 | -5631 | -5968 | -5855 | 3636 | -5191 | -5659 | -5782 | -5315 | -43 | -4307 | -4339 | -5276 | -5458 | -2909 | -3130 | -4427 | -6076 | -6026 | 449 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |
| 418 | -188 | -3252 | -5668 | -6022 | -5929 | -3522 | -5224 | -5788 | -5864 | -6041 | -5081 | -4312 | -4334 | -5314 | -5517 | 3642 | -3124 | -4468 | -6125 | -6098 | 450 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -3 | -9550 | -10592 | -894 | -1115 | -701 | -1378 | * | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT      -8455     -4   -8455     -4   -8455     -4   -8455
NULT       -4   -8455
NULE      595  -1558   85    338   -294  -8455   453  -1158   197   249   902  -1085  -142   -21   -313    45   531   201   384  -1998   -644
           A      C     D      E      F      G     H      I     K     L      M     N      P     Q      R     S     T     V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 419 | -3937 | -3451 | -6606 | -6334 | -4002 | -6298 | -6475 | 3965 | -6299 | -2737 | -2721 | -6104 | -6130 | -6206 | -6432 | -5734 | -3949 | 30 | -5766 | -5281 | 451 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 420 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 452 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 421 | -6234 | -5148 | -6596 | -6958 | 1876 | -6465 | -2679 | -5126 | -6520 | -4427 | -4526 | -5102 | -6332 | -5244 | -5881 | -5741 | -6088 | -5286 | -1926 | 4688 | 453 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 422 | 10 | -3182 | -5823 | -6163 | -5898 | -3463 | -5215 | -5716 | -5868 | -5982 | -5009 | -4285 | -4279 | -5307 | -5491 | 1049 | 3703 | -4395 | -6119 | -6099 | 454 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 423 | -4994 | -4428 | -7368 | -6797 | 772 | -7026 | -5656 | -2020 | -6572 | 3172 | -1356 | -6776 | -6184 | -5359 | -6056 | -6370 | -1311 | -1114 | -4293 | -4363 | 455 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 424 | 151 | -3357 | -5518 | -5879 | -6031 | -1391 | -5256 | -5892 | -5884 | -6129 | -5180 | -4365 | -4123 | -5337 | -5573 | -3008 | -3233 | -4579 | -6163 | -6190 | 456 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 425 | 3585 | -76 | -5953 | -6299 | -5900 | -3466 | -5246 | -5718 | -5922 | -5990 | -5017 | -4311 | -4284 | -5352 | -5518 | -628 | -3056 | -4396 | -6122 | -6109 | 457 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 426 | 2335 | -2033 | -4488 | -3883 | -2036 | -3651 | -2660 | -1502 | -3497 | 1390 | 315 | -3362 | -3761 | -3130 | -3320 | -823 | 1243 | 395 | -2553 | -2213 | 458 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 427 | -4457 | -4009 | -6802 | -6193 | 2616 | -6309 | -4972 | 610 | -5896 | 2458 | 209 | -5975 | -5766 | -4965 | -5498 | -5521 | -4332 | -835 | -3995 | 1086 | 459 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 428 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 460 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 429 | 2612 | 472 | -5872 | -6102 | -5620 | -2098 | -5093 | -5381 | -5732 | -5664 | -4748 | -4262 | -4260 | -5202 | -5388 | 1752 | 1902 | -1435 | -5886 | -5809 | 461 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 430 | 430 | 1087 | -2441 | -1346 | -2572 | -307 | 743 | -2160 | -1739 | -212 | -576 | -2062 | -3238 | 3683 | -2108 | -2124 | -1911 | -1989 | -2884 | -2418 | 462 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 431 | -2120 | -2921 | -5674 | -5112 | -2717 | -5049 | -4050 | 1716 | -4792 | 2048 | 1556 | -4702 | -4954 | -4373 | -4619 | -4197 | 1898 | 503 | -3707 | -3428 | 463 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4  -8455    -4  -8455    -4  -8455    -4
NULT     -4  -8455
NULE    595 -1558 -1000 -1000 -1000   -4 -8455   -4  -1085 -142  -21 -313   45  531  201  384 -1998  -644
HMM       A     C     D     E     F     G     H     I     K     L     M     N     P     Q     R     S     T     V     W     Y
       -149  -500   233    43  -381   399   106  -626   210  -466  -720   275   394    45    96   359   117  -369  -294  -249
         -3 -9550 -10592  -894 -1115  -701 -1378     *     *
432    3629 -3601 -5879 -6239 -6218 -2817 -5483 -6134 -6147 -6344 -5431 -4660 -4649 -5621 -5787 -3290 -3510 -4842 -6211 -6375   464
       -149  -500   233    43  -381   399   106  -626   210  -466  -720   275   394    45    96   359   117  -369  -294  -249
433    1018  2365  1762   379 -3637 -2817  1089 -3387  -375 -1986 -2405  1644 -2910   897  -320  -544  -964 -2938 -3499 -2816   465
       -149  -500   233    43  -381   399   106  -626   210  -466  -720   275   394    45    96   359   117  -369  -294  -249
434   -1101 -3220 -1751  -262 -3498 -2850 -1511 -3217   898  -860  -505 -1503  3281  -361  -264  -264  -732 -1794 -3430 -2776   473
       -149  -500   233    43  -381   399   106  -626   210  -466  -720   275   394    45    96   359   117  -369  -294  -249
435   -1466 -3321  1471  1410 -3642   117  1359 -3392   317 -3337 -2410  1377 -2913  1172 -1568   961  -828 -2943 -3504 -1312   474
       -149  -500   233    43  -381   399   106  -626   210  -466  -720   275   394    45    96   359   117  -369  -294  -249
436   -4518 -5051 -5556 -3816 -6068 -4927 -2688 -5258    -6 -4837 -4203 -3600 -4829   150  4007 -1159 -4120 -5065 -4627 -4615   475
       -149  -500   233    43  -381   399   106  -626   210  -466  -720   275   394    45    96   359   117  -369  -294  -249
437   -4188 -4636 -5602 -4944 -6253 -4721 -4046 -6179 -2825 -5921 -5269 -4528 -5174 -3748 -4191 -1690 -4383 -5524 -5484 -5519   476
       -149  -500   233    43  -381   399   106  -626   210  -466  -720   275   394    45    96   359   117  -369  -294  -249
438   -1889 -2878 -1977 -1426 -3035 -1468  2360 -2680 -1325 -2211  -835  2293  -379   508 -1786  -149   200  1992 -3171 -2606   477
       -149  -500   233    43  -381   399   106  -626   210  -466  -720   275   394    45    96   359   117  -369  -294  -249
439   -3959 -3434 -4649 -6329 -3875 -6524 -6532  3066 -6309   487 -2567 -6181 -6194 -6170 -6448 -5919 -3945  2482 -5708 -5295   478
       -149  -500   233    43  -381   399   106  -626   210  -466  -720   275   394    45    96   359   117  -369  -294  -249
440   -4708   878 -7255 -6791 -2726 -6537 -5861 -1906 -6573  3235 -1509 -6587 -6085 -5474 -6118 -5929 -4674  -504 -4518 -4659   479
       -149  -500   233    43  -381   399   106  -626   210  -466  -720   275   394    45    96   359   117  -369  -294  -249
441   -3885 -3510 -6292 -5713  1957 -5727 -4605  2058 -5408  2414 -1461 -5391 -5428 -4743 -5135 -1616 -3803  -430 -3923 -3794   480
       -149  -500   233    43  -381   399   106  -626   210  -466  -720   275   394    45    96   359   117  -369  -294  -249
442   -3578 -3156 -6190 -5786 -3696 -5765 -5316  3605 -5620 -1128 -2525 -5463 -5654 -5443 -5637 -1663   359  1072 -4966 -4526   481
       -149  -500   233    43  -381   399   106  -626   210  -466  -720   275   394    45    96   359   117  -369  -294  -249
443   -6820 -6058 -7070 -7454 -7683  3860 -6792 -8642 -7678 -8092 -7936 -7259 -6560 -7508  7152 -7196 -7139 -8047 -6473 -7685   482
       -149  -500   233    43  -381   399   106  -626   210  -466  -720   275   394    45    96   359   117  -369  -294  -249
```

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT      -8455     -4  -8455     -4  -1000     -1000    -8455
NULT      -4    -8455
NULE     595   -1558
HMM        A       C       D       E       F       G       H       I       K       L       M       N       P       Q       R       S       T       V       W       Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | -3 | -9550 | -10592 | -894 | -1115 | -701 | -1378 | | | | | | | | | | | | | | |
| 444 | -7014 | -6306 | 4224 | -5700 | -7594 | -5941 | -6176 | -8542 | -6898 | -7975 | -7846 | -5993 | -6426 | -6415 | -6929 | -7061 | -7171 | -8132 | -6465 | -7357 | 483 |
| | -149 | -500 | -500 | -894 | -381 | -701 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 445 | -6820 | -6058 | -7070 | -7454 | -7683 | 3860 | -6792 | -8642 | -7678 | -8092 | -7936 | -7259 | -6560 | -7508 | -7152 | -7196 | -7139 | -8047 | -6473 | -7685 | 484 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 446 | 2074 | -3225 | -5740 | -6091 | -5922 | -3499 | -5227 | -5767 | -5878 | -6025 | -5058 | -4306 | -4314 | -5319 | -5515 | 3168 | -3097 | -4443 | -6127 | -6105 | 485 |
| | -149 | -500 | 233 | 43 | -381 | -701 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 447 | 2551 | -4132 | -6676 | -6410 | 2806 | -5642 | -4373 | -2425 | -6103 | 1279 | -1791 | -5615 | -5659 | -5154 | -5675 | -4967 | -4402 | -3055 | -3540 | -2817 | 486 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 448 | -5571 | -5510 | -5464 | -5542 | -4991 | -5571 | -5041 | -5636 | -4641 | -1259 | -4981 | -5471 | -5990 | -4546 | -4607 | -5743 | -5726 | -5868 | -5317 | -4898 | 487 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 449 | -5290 | -4627 | -7651 | -7045 | -154 | -7513 | -6025 | -2069 | -6860 | 3135 | 1997 | -7253 | -6355 | -5467 | -6255 | -6940 | -5102 | -1478 | -4412 | -4668 | 488 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 450 | -2617 | -3226 | -5575 | -5905 | -5785 | -3498 | -5134 | -4289 | -5670 | -5916 | -4997 | -4263 | -4308 | -5215 | -5366 | -1426 | -1331 | -4388 | -6031 | -5907 | 489 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 451 | 1563 | -3339 | -6536 | -6241 | -4109 | -6241 | -6449 | 2319 | -6211 | -2874 | -2793 | -6000 | -6077 | -6184 | -6384 | -5622 | -3830 | 2812 | -5869 | -5323 | 490 |
| | -149 | -500 | 233 | -894 | -381 | -701 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 452 | -4063 | -4579 | -4421 | -4655 | -6179 | -4548 | -4778 | -6468 | -4363 | -6356 | -5760 | -4489 | -5188 | 4555 | -4400 | -4220 | -1331 | -5623 | -5906 | -5808 | 491 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 453 | -1088 | -5589 | -752 | 3719 | -6176 | -1340 | -3292 | -6148 | -3695 | -6014 | -5406 | -2436 | -4364 | -2987 | -4657 | -899 | -4024 | -5506 | -6215 | -5141 | 492 |
| | -149 | -500 | 233 | 43 | -381 | -701 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 454 | -4707 | -4179 | -7117 | -6536 | -2603 | -6772 | -5546 | 1205 | -6300 | 2876 | 1891 | -6469 | -6048 | -5265 | -2757 | -6060 | -4579 | 8 | -4324 | -4455 | 493 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -13 | -9550 | -6991 | -894 | -1115 | -701 | -1378 | * | * | | | | | | | | | | | | |
| 455 | -661 | -3188 | -5652 | -6007 | -5910 | 2743 | -5192 | -5742 | -5850 | -5999 | -5024 | -4256 | -4276 | -5274 | -5494 | 2692 | -3056 | -4407 | -6125 | -6101 | 494 |
| | -3 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT     -8455     -4   -8455     -4   -1000  -1000  -1000   -294   -8455     -4   -8455     -4          249    902  -1085   -142    -21   -313     45    531    201    384  -1998   -644
NULT     -4   -8455
NULE    -149
HMM       A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 456 | -1414 | -2264 | -3236 | -2681 | -2348 | -3362 | -2310 | -1323 | -2485 | -1229 | -1540 | -1620 | -3503 | -630 | -2695 | 2050 | 2945 | -407 | -2773 | -2380 | 495 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 457 | -491 | -1961 | -4486 | -3851 | 656 | -3694 | -2565 | 1905 | -3448 | -481 | 4260 | -3340 | -3736 | -3065 | -3247 | -1788 | -2080 | -565 | 561 | -2081 | 496 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 458 | -564 | -1881 | -4389 | -3753 | -411 | -2111 | -2470 | 2108 | -3350 | 2217 | 542 | -3242 | -1247 | -1296 | -3154 | -937 | -1993 | -557 | -2338 | -818 | 497 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 459 | -4739 | -5210 | -4220 | -4019 | -6188 | -5006 | -3133 | -5679 | -1728 | -5266 | -4654 | -3885 | -5070 | -663 | -4163 | -4635 | -4460 | -5436 | -4956 | -4939 | 498 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 460 | -1859 | -3332 | 2176 | 1662 | -3653 | -2826 | 547 | -3404 | -447 | -1327 | -2422 | -281 | -2922 | 2156 | -260 | -1738 | -1799 | -2954 | -3515 | 1453 | 499 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 461 | -1970 | -3450 | 818 | -118 | -3771 | 2172 | 742 | -3523 | 1425 | -3463 | -2543 | 1312 | -3013 | 805 | 315 | -1843 | -1911 | -3073 | -3627 | -2942 | 500 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 462 | -4602 | -4080 | -7027 | -6481 | -2681 | -6716 | -5588 | 1460 | -6221 | 2520 | -1425 | -6402 | -6046 | 2476 | -5865 | -6018 | -4493 | -309 | -4404 | -4500 | 501 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 463 | -697 | -3338 | -1723 | -1171 | -3663 | -2843 | 823 | -3409 | 2751 | -3351 | -2428 | 1887 | -1087 | -411 | 142 | 253 | 17 | -2962 | -3515 | -2840 | 502 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 464 | -508 | -2733 | -4958 | -4645 | -3515 | -1510 | -3753 | -1905 | -4311 | -2151 | -202 | -3795 | 4000 | -3989 | -4205 | -2780 | -926 | -2720 | -3982 | -3675 | 503 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 465 | -1531 | -3082 | -6077 | -5643 | -3590 | -5668 | -5070 | 2883 | -1664 | -1114 | -2455 | -5319 | -5545 | -5258 | -5444 | -4906 | -1178 | 2757 | -4760 | -4327 | 504 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 466 | -3638 | 466 | -6232 | -5813 | -3550 | -5867 | -5292 | 3665 | -5646 | -560 | -2393 | -5518 | -5690 | -5418 | -5641 | -5127 | -3614 | 939 | -4859 | -38 | 505 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 467 | -4630 | -4091 | -7087 | -6550 | 3782 | -6796 | -5664 | 714 | -6352 | 844 | -505 | -6485 | -6090 | -5370 | -5975 | -6109 | -4520 | 1155 | -4431 | -4517 | 506 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | * | | | | | | | | | | | | |
| 468 | -4360 | -3808 | -6964 | -6557 | -3143 | -6813 | -6234 | 257 | -6473 | 2551 | -1884 | -6497 | -6226 | -5790 | -6315 | -6208 | -4305 | 2454 | -4983 | -4968 | 507 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455   -4   -1000   -1000   -8455   -4   -8455   -4
NULT  -4      -8455
NULE  595
HMM        A       C       D       E       F       G       H       I       K       L       M       N       P       Q       R       S       T       V       W       Y
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 469    -4323   -3778    -6922   -6508   -3143   -6756   -6153   2761    -6415   1907    317     -6432   -6191   -5752   -6261   -6133   -4268   1694    -4958   -4931   508
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 470    -4779   -5848    -892    -3060   -6636   -4525   -4227   -7028   -4717   -6802   -6327   4376    -5123   -4007   -5533   -4529   -4963   -6384   -6313   -5849   509
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 471    -6510   -5994    -6070   -6452   -7251   -5898   -6379   -8368   -7089   -7883   -7678   4452    -6410   -6832   -6854   -6751   -6807   -7779   -6351   -7068   510
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 472    -1538   -4183    3319    1047    -4471   -300    -95     -4258   -1891   -4186   -3306   1073    -3499   320     -2468   -1381   -2579   -3792   -4359   -2367   511
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 473    -6803   -6045    -7057   -7441   -7671   3860    -6780   -8628   -7666   -8080   -7923   -7245   -6548   -7495   -7140   -7178   -7123   -8032   -6462   -7673   512
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 474    -7100   -5902    -6970   -7339   -3194   -6279   -4485   -6826   -7282   -6139   -6213   -6465   -6584   -6588   -6717   -7063   -7139   -6872   -3783   4945    513
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 475    -1314   -3313    -5039   -5322   -5885   -3551   -4925   -5645   -2746   -5913   -5008   -4155   -4343   -4901   -4922   -2940   4007    -4448   -6032   -5944   514
         -149    -500    233     43      -381    399     106     -626    210     -466    -720    275     394     45      96      359     117     -369    -294    -249
           -3    -9539   -10581  -894    -1115   -842    -1178   *       *       *       *       *       *       *       *       *       *       *       *       *
 476    -3893   -3371    -6597   -6296   -4087   -6475   -6627   2196    -6289   -2227   -2759   -6133   -6192   -6276   -6491   -5875   -3887   3409    -5929   -5382   515
         -149    -500    233     43      -381    399     106     -626    210     -466    -720    275     394     45      96      359     117     -369    -294    -249
           -3    -9550   -10592  -894    -1115   -701    -1378   *       *       *       *       *       *       *       *       *       *       *       *       *
 477    -4917   -6083    -2614   3919    -6686   -4565   -4135   -6991   -4414   -6721   -6267   -3384   -5137   -2025   -5067   -4603   -5042   -6448   -6286   -5827   516
         -149    -500    233     43      -381    399     106     -626    210     -466    -720    275     394     45      96      359     117     -369    -294    -249
           -3    -9550   -10592  -894    -1115   -701    -1378   *       *       *       *       *       *       *       *       *       *       *       *       *
 478    -4984   -5192    -6260   -5405   -6240   -5261   -4357   -6356   -3138   -6048   -5561   -5048   -5615   -4100   4225    -5112   -5068   -2975   -5549   -5604   517
         -149    -500    233     43      -381    399     106     -626    210     -466    -720    275     394     45      96      359     117     -369    -294    -249
           -3    -9550   -10592  -894    -1115   -701    -1378   *       *       *       *       *       *       *       *       *       *       *       *       *
 479    2638    325      -1215   -1193   -305    -3455   -2272   -1557   -1045   682     894     -2786   -3515   -1596   -2771   -1339   -1966   -1055   -2474   991     518
         -149    -500    233     43      -381    399     106     -626    210     -466    -720    275     394     45      96      359     117     -369    -294    -249
           -3    -9550   -10592  -894    -1115   -701    -1378   *       *       *       *       *       *       *       *       *       *       *       *       *
 480    -4030   -3609    -6609   -6400   -3937   -6043   -6251   4011    -6320   -2712   -2740   -6063   -6045   -6132   -6351   -5549   -4077   -788    -5562   -5130   519
```

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4    -1000   -1000   -8455   -4    -8455   -4
NULT  -4       -8455
NULE  595      -1558   85     338    -294    453   -1158   197    249    902    -1085   -142   -21    -313    45     531    201    384    -1998   -644
HMM            A       C      D      E       F     G       H      I      K      L       M      N      P      Q       R      S      T      V      W       Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 481 | -3237 | -3518 | -10592 | -894 | -1115 | -701 | -1378 | * | -1613 | 256 | -58 | -901 | -4264 | -2337 | -66 | -2444 | -3109 | -3106 | -3619 | -3221 | 520 |
| | -149 | -500 | -4079 | -3274 | -3507 | -4212 | 4961 | -3235 | 210 | -466 | -720 | 275 | 394 | 45 | 96 | 359 | 117 | -369 | -294 | -249 | |
| | -3 | -9550 | 233 | -894 | -1115 | 399 | 106 | -626 | | | | | | | | | | | | | |
| 482 | -5124 | -5281 | -5605 | -5973 | -7088 | 3838 | -6016 | -7671 | -6503 | -7457 | -6958 | -5744 | -5910 | -2344 | -6374 | -5346 | -5523 | -6733 | -6350 | -6953 | 521 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 483 | 930 | -3124 | -1807 | 2107 | -3364 | -2877 | -1545 | -3058 | -1162 | -3105 | 2169 | -1551 | 1921 | 639 | -535 | -1390 | -1807 | -1736 | 1084 | -2731 | 522 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 484 | -490 | -3316 | 1098 | 1747 | -3638 | -2817 | 482 | -2797 | 108 | -3332 | -2406 | 2169 | -2910 | 1035 | -573 | -1393 | 888 | -2938 | -3500 | -867 | 523 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 485 | 814 | -3363 | -1751 | 1620 | -3690 | -2707 | -1542 | -3431 | -1106 | -3381 | -117 | -1522 | -2979 | 3123 | 291 | 543 | -1857 | -2991 | -3551 | -2881 | 524 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 486 | -264 | -3093 | -1818 | 370 | -3322 | -2879 | -1549 | -3010 | -479 | -1596 | -711 | -1559 | 2041 | -1127 | 2224 | 906 | -836 | -488 | -3334 | -124 | 525 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 487 | -6291 | -5271 | -6494 | -6839 | -1480 | -6354 | -1157 | -5379 | -6475 | -4685 | -4776 | -5263 | -6345 | -5399 | -5923 | -5880 | -6194 | -5515 | -2191 | 4901 | 526 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |
| 488 | -6510 | -5994 | -6070 | -6452 | -7251 | -5898 | -6379 | -8368 | -7089 | -7883 | -7678 | 4452 | -6410 | -6832 | -6854 | -6751 | -6807 | -7779 | -6351 | -7068 | 527 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1178 | * | | | | | | | | | | | | | |
| 489 | -4119 | -6225 | 3992 | -75 | -6330 | -3804 | 98 | -6355 | -3752 | -6170 | -5646 | -363 | -4410 | -2978 | -4819 | -3703 | -4230 | -5780 | -6375 | -5193 | 528 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -13 | -9539 | -10581 | -894 | -1115 | -701 | -1178 | * | | | | | | | | | | | | | |
| 490 | -3861 | -3366 | -6568 | -6280 | -4066 | -6328 | -6548 | 3902 | -6257 | -2798 | -2748 | -6068 | -6125 | -6224 | -6436 | -5726 | -3204 | -654 | -5883 | -5351 | 529 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -842 | -1178 | * | | | | | | | | | | | | | |
| 491 | 1953 | -3302 | -855 | -1136 | -1694 | -890 | 743 | -3368 | -452 | -3316 | -2391 | -120 | 828 | 2272 | -362 | -971 | 53 | -1028 | -3487 | -2806 | 530 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -619 | -1519 | * | | | | | | | | | | | | | |
| 492 | 694 | -3246 | -1727 | -596 | -3535 | -1348 | -512 | -3009 | -450 | -828 | 3372 | 863 | 516 | 386 | 499 | -487 | -732 | -260 | -3448 | -2785 | 531 |
| | -149 | -500 | 233 | -894 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT      -8455     -4  -8455     -4  -8455     -4
NULT       -4  -8455
NULE      595   1105  -6521     85    338   -294  -8455  -1158     -4    453   -8455    -1085   -142    -21   -313     45    531    201    384  -1998   -644
HMM         A      C      D      E      F      G      H      I      K      L      M      N      P      Q      R      S      T      V      W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 493 | -4610 | 1105 | -6521 | -6808 | -3706 | -5094 | -4730 | -6455 | -6383 | -6131 | -5857 | -2463 | -5708 | -6082 | -6034 | -4831 | -5011 | -5865 | 6217 | -3278 | 532 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 494 | -2192 | -3688 | 2691 | -902 | -4006 | -3040 | 733 | -3762 | 118 | -3696 | -2788 | 2708 | -3191 | 284 | 392 | -1003 | -2138 | -3311 | -3858 | -3163 | 533 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 495 | -6213 | -5135 | -6592 | -6945 | -1195 | -6465 | -2671 | -5078 | -6487 | -1797 | -4476 | -5093 | -6325 | -5228 | -5857 | -5729 | -6066 | -5250 | -5262 | 3836 | 534 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 496 | 52 | -3327 | -1710 | -1161 | -3649 | -2834 | 738 | -3397 | 1072 | -3442 | -2417 | 59 | -1838 | 1192 | -670 | 9 | 2832 | -2950 | -3509 | -2830 | 535 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9550 | -10592 | -894 | -1115 | -701 | -1378 | * | * | | | | | | | | | | | | |
| 497 | 1182 | -3308 | -75 | 934 | -3628 | -516 | -756 | -3379 | 1440 | -528 | -2397 | -654 | -2902 | 2112 | 18 | -1027 | -1774 | -869 | -3491 | -2808 | 536 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 498 | -4366 | -3863 | -6861 | -6350 | -2813 | -6532 | -5557 | -1257 | -6153 | 2852 | 799 | -6213 | -5980 | -5347 | -5868 | -5821 | -1332 | 675 | -4490 | -4513 | 537 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 499 | 534 | -2066 | -4488 | -3891 | -850 | -3675 | -2705 | -573 | -3515 | -1134 | -1321 | -3385 | 3680 | -3158 | -3354 | -1576 | -1835 | -160 | -2611 | -2268 | 538 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 500 | 1136 | -3308 | -100 | 534 | -3629 | -1385 | -1337 | -3380 | 1198 | -3324 | -468 | 586 | -1686 | 2253 | 307 | -502 | -809 | -2930 | -3491 | -2808 | 539 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 501 | 2420 | -2147 | -4409 | -3851 | -592 | -3575 | -2776 | -1426 | -3506 | -2137 | -1491 | -477 | -3777 | -3170 | -3389 | -1641 | 850 | 2260 | -2753 | -2409 | 540 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 502 | -5318 | -4643 | -7588 | -7040 | 3618 | -7449 | -5566 | -2117 | -6841 | 2217 | 417 | -7066 | -6348 | -5450 | -6233 | -6867 | -5131 | -3019 | -4158 | -4002 | 541 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 503 | 283 | 678 | 316 | -1176 | -3551 | 2609 | -54 | -3283 | -596 | -3263 | -557 | 1036 | -2926 | -1048 | -1593 | 437 | -1286 | -2707 | -3458 | -2793 | 542 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9539 | -10581 | -894 | -1115 | -701 | -1378 | * | * | | | | | | | | | | | | |
| 504 | 1172 | -2879 | -1255 | -1404 | -3039 | 1552 | -1623 | -1912 | 43 | 27 | -742 | -785 | -122 | -1246 | -5 | -660 | 537 | 714 | -3169 | -2601 | 543 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -155 | -9539 | -10581 | -894 | -1115 | -701 | -1378 | * | * | | | | | | | | | | | | |
| 505 | 168 | -3192 | 1294 | 1378 | -3513 | 246 | 18 | -3264 | 1005 | -3208 | -2281 | 1105 | -1492 | 323 | -304 | -1599 | 1121 | -2814 | -3375 | -2692 | 544 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455    -4   -8455    -4   -8455    -4   -8455    -4
NULT  -4    -8455
NULE  595  -1558  -1000 -1000  -294  -1000  -8455   -4   -1158  -1085  -142  -21  -313   45   531   201   384   -1998   -644
HMM          A      C      D     E     F     G     H     I     K     L     M     N     P     Q     R     S     T     V     W     Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| — | -148 | -501 | 237 | 45 | -381 | 398 | 105 | -627 | 210 | -466 | -720 | 275 | 394 | 45 | 96 | 358 | 116 | -370 | -295 | -250 | |
| | -534 | -1695 | -10429 | -234 | -2740 | -412 | -2008 | * | * | | | | | | | | | | | | |
| 506 | 120 | 1125 | 1556 | 1257 | -1015 | -295 | 1718 | -1288 | 536 | -3305 | -2379 | 254 | -844 | 32 | -590 | -353 | -522 | -659 | -3473 | -2790 | 547 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -131 | -9517 | -3548 | -894 | -1115 | -983 | -1018 | * | * | | | | | | | | | | | | |
| 507 | -710 | -177 | -1009 | 928 | -3512 | -559 | -1352 | -3263 | 974 | -2470 | -2281 | 1286 | -1120 | 2059 | 1077 | -1116 | 696 | -1220 | 675 | -2692 | 548 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -38 | -9389 | -5358 | -894 | -1115 | -1962 | -428 | * | * | | | | | | | | | | | | |
| 508 | 1420 | 202 | -4147 | -3517 | -972 | -1350 | 104 | 33 | -3134 | -1588 | 735 | -3049 | 945 | -2775 | -2968 | 1280 | -1838 | 1825 | -2195 | -404 | 549 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -40 | -9355 | -5266 | -894 | -1115 | -363 | -2168 | * | * | | | | | | | | | | | | |
| 509 | -1059 | -3007 | -638 | 973 | 220 | -2838 | -1510 | -1499 | 429 | 1366 | -906 | -1525 | -2928 | 1754 | 167 | -1209 | 261 | -62 | -3256 | -2644 | 550 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9484 | -10526 | -894 | -1115 | -1314 | -742 | * | * | | | | | | | | | | | | |
| 510 | -126 | 3208 | -4392 | -3767 | -1888 | -3624 | -2524 | 198 | -3376 | -1364 | -274 | -3270 | -3682 | -3010 | -3195 | 1352 | 2356 | 769 | -2402 | -2058 | 551 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9484 | -10526 | -894 | -1115 | -719 | -1349 | * | * | | | | | | | | | | | | |
| 511 | -1329 | 2072 | -4340 | -1658 | 1935 | -3577 | 2398 | -61 | -843 | 471 | -330 | -3210 | -3627 | -2940 | -143 | -2660 | -1974 | -81 | 3627 | 824 | 552 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9517 | -10559 | -894 | -1115 | -983 | -1018 | * | * | | | | | | | | | | | | |
| 512 | -626 | -2032 | 1111 | -591 | -3587 | -2796 | -1455 | -1237 | 1667 | -2216 | 417 | -372 | -2889 | 33 | 2532 | -784 | -1104 | -59 | -3462 | -2783 | 553 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9517 | -10559 | -894 | -1115 | -3813 | -5371 | * | * | | | | | | | | | | | | |
| 513 | 1143 | -337 | -6156 | -5870 | -3921 | -3813 | 106 | 107 | -5688 | -2944 | -2745 | -5225 | -5343 | -5472 | -5657 | -4401 | -3466 | 3457 | -5166 | -4738 | 554 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -2788 | -386 | * | * | | | | | | | | | | | | |
| 514 | -356 | -86 | -1662 | 1664 | -914 | -2788 | -1018 | -3356 | 563 | -3301 | -2375 | 805 | -2882 | 367 | 552 | 1144 | 1516 | -2907 | -3469 | -2787 | 555 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -2831 | -1018 | * | * | | | | | | | | | | | | |
| 515 | -1883 | 118 | -506 | 922 | -3675 | -2831 | 107 | -3426 | -1101 | -3372 | -2449 | 850 | -2938 | 1289 | -1613 | 389 | 2831 | -2978 | -3542 | -2855 | 556 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -842 | -1521 | * | * | | | | | | | | | | | | |
| 516 | 925 | -3078 | -1785 | 1662 | -3315 | -842 | 106 | -3007 | -1144 | -3060 | -2195 | -1527 | 325 | -1096 | -692 | 734 | 1006 | 856 | -3320 | 793 | 557 |
| — | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -1308 | 30 | * | * | | | | | | | | | | | | |
| 517 | 450 | -3284 | -438 | 811 | -3604 | 1308 | 106 | 146 | 529 | -3299 | -2373 | 530 | -2882 | 693 | -1536 | -242 | 646 | 189 | -3468 | -2786 | 558 |
| — | -149 | -500 | 233 | 43 | -381 | 399 | 106 | -626 | 210 | -466 | -720 | 275 | 394 | 45 | 96 | 359 | 117 | -369 | -294 | -249 | |

TABLE Z-continued

```
HMMER2.0 [2.2 g]
NAME   sel_kivd
LENG   562
ALPH   Amino
RF     no
CS     no
MAP    yes
COM    hmmbuild -n sel_kivd sel_kivd.hmm sel_kivd.aln.fa
NSEQ   170
DATE   Wed Apr. 25 16:17:47 2012
CKSUM  3974
XT     -8455    -4  -8455    -4  -8455    -4  -8455    -4
NULT      -4  -8455
NULE     595  -1558   85   338  -294  -1000 -1000 -1000 -1000  453    -4 -1158    -4  197  249  902 -1085 -142  -21  -313   45  531  201  384 -1998  -644
HMM        A      C    D     E     F     G     H     I    K    L    M    N    P    Q    R    S    T    V    W    Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 518 | -3<br>-131<br>-149 | -9513<br>-5188<br>-500 | -10555<br>958<br>233 | -894<br>2748<br>43 | -1115<br>-5424<br>-381 | -983<br>-912<br>399 | -1018<br>-2788<br>106 | *<br>-5291<br>-626 | *<br>-2848<br>210 | -5182<br>-466 | -4416<br>-720 | -2172<br>275 | -4026<br>394 | 2916<br>45 | -3585<br>96 | -1969<br>359 | -3446<br>117 | -4785<br>-369 | -5368<br>-294 | -4453<br>-249 | 559 |
| | | -9513 | -10555 | -894 | -1115 | -983 | -1018 | | | | | | | | | | | | | | |
| 519 | -5219<br>-149 | -4566<br>-500 | -7550<br>233 | -6984<br>43 | 639<br>-381 | -7379<br>399 | -5749<br>106 | -2032<br>-626 | -6792<br>210 | 3204<br>-466 | -1321<br>-720 | -7075<br>275 | -6305<br>394 | -5431<br>45 | -6204<br>96 | -6797<br>359 | -5043<br>117 | -708<br>-369 | -4265<br>-294 | -4283<br>-249 | 560 |
| | -3 | -9513 | -10555 | -894 | -1115 | -983 | -1018 | * | * | | | | | | | | | | | | |
| 520 | 1203<br>-149 | -3289<br>-500 | 1142<br>233 | 1536<br>43 | -3610<br>-381 | -2790<br>399 | -1448<br>106 | -3361<br>-626 | 1367<br>210 | -3305<br>-466 | -343<br>-720 | -499<br>275 | -2883<br>394 | 1503<br>45 | 811<br>96 | -1696<br>359 | -1755<br>117 | -1255<br>-369 | -3472<br>-294 | -2790<br>-249 | 561 |
| | -3 | -9513 | -10555 | -894 | -1115 | -983 | -1018 | * | * | | | | | | | | | | | | |
| 521 | 904<br>-149 | -3287<br>-500 | 1101<br>233 | 2037<br>43 | -3608<br>-381 | -2788<br>399 | -1447<br>106 | -3359<br>-626 | 429<br>210 | -1036<br>-466 | -2376<br>-720 | 335<br>275 | -2881<br>394 | 1398<br>45 | -677<br>96 | -94<br>359 | -980<br>117 | -1589<br>-369 | -3470<br>-294 | -2788<br>-249 | 562 |
| | -3 | -9513 | -10555 | -894 | -1115 | -983 | -1018 | * | * | | | | | | | | | | | | |
| 522 | 2435<br>-149 | -2606<br>-500 | -5242<br>233 | -4770<br>43 | -2960<br>-381 | -4168<br>399 | -3719<br>106 | -818<br>-626 | -4434<br>210 | -1753<br>-466 | -2071<br>-720 | -4137<br>275 | -4424<br>394 | -4098<br>45 | -4287<br>96 | -2159<br>359 | 664<br>117 | 2558<br>-369 | -3631<br>-294 | -3278<br>-249 | 563 |
| | -3 | -9513 | -10555 | -894 | -1115 | -983 | -1018 | * | * | | | | | | | | | | | | |
| 523 | -5255<br>-149 | -4571<br>-500 | -7584<br>233 | -6979<br>43 | 1880<br>-381 | -7427<br>399 | -5937<br>106 | -2032<br>-626 | -6788<br>210 | 2790<br>-466 | 2658<br>-720 | -7159<br>275 | -6301<br>394 | -5415<br>45 | -6193<br>96 | -6839<br>359 | -5040<br>117 | -1168<br>-369 | -4358<br>-294 | -4589<br>-249 | 564 |
| | -3 | -9513 | -10555 | -894 | -1115 | -983 | -1018 | * | * | | | | | | | | | | | | |
| 524 | 1079<br>-149 | -3287<br>-500 | 989<br>233 | 1856<br>43 | -3608<br>-381 | -1579<br>399 | -508<br>106 | -1678<br>-626 | 470<br>210 | -1582<br>-466 | -1586<br>-720 | 150<br>275 | -2881<br>394 | 187<br>45 | -284<br>96 | -740<br>359 | 1058<br>117 | -2774<br>-369 | -3470<br>-294 | -2787<br>-249 | 565 |
| | -3 | -9513 | -10555 | -894 | -1115 | -983 | -1018 | * | * | | | | | | | | | | | | |
| 525 | 534<br>-149 | -3287<br>-500 | -144<br>233 | 1270<br>43 | -3608<br>-381 | -2788<br>399 | 293<br>106 | -3359<br>-626 | 999<br>210 | -1440<br>-466 | -2376<br>-720 | 512<br>275 | -2881<br>394 | 1717<br>45 | 1260<br>96 | -504<br>359 | -638<br>117 | -37<br>-369 | -3470<br>-294 | -2788<br>-249 | 566 |
| | -51 | -9513 | -4893 | -894 | -1115 | -983 | -1018 | * | * | | | | | | | | | | | | |
| 526 | 1975<br>-149 | -2759<br>-500 | -5585<br>233 | -5075<br>43 | -3040<br>-381 | -4974<br>399 | -4154<br>106 | 2312<br>-626 | -4790<br>210 | 765<br>-466 | -2038<br>-720 | -4654<br>275 | -4945<br>394 | -4498<br>45 | -4688<br>96 | -1747<br>359 | -3056<br>117 | 1608<br>-369 | -3927<br>-294 | -3550<br>-249 | 567 |
| | -3 | -9464 | -10506 | -894 | -1115 | -1444 | -661 | * | * | | | | | | | | | | | | |
| 527 | 1225<br>-149 | -3250<br>-500 | 209<br>233 | 1056<br>43 | -3571<br>-381 | -892<br>399 | -663<br>106 | -1231<br>-626 | 306<br>210 | -3266<br>-466 | -2339<br>-720 | 1413<br>275 | -1081<br>394 | 1147<br>45 | -549<br>96 | 564<br>359 | 319<br>117 | -2761<br>-369 | -3433<br>-294 | -2750<br>-249 | 568 |
| | -519 | -9464 | -1734 | -894 | -1115 | -1444 | -661 | | | | | | | | | | | | | | |
| 528 | 1881<br>-149 | -2851<br>-500 | -318<br>233 | 543<br>43 | -216<br>-381 | -1147<br>399 | -1035<br>106 | -1070<br>-626 | 687<br>210 | -1957<br>-466 | -1942<br>-720 | -813<br>275 | -2468<br>394 | 1096<br>45 | 399<br>96 | 70<br>359 | -381<br>117 | -768<br>-369 | -3039<br>-294 | -2362<br>-249 | 569 |
| | -4 | -8950 | -9992 | -98 | -3608 | -161 | -3246 | * | * | | | | | | | | | | | | |
| 529 | 514<br>-149 | -3287<br>-500 | 1018<br>233 | -894 | -3608<br>-381 | -974<br>399 | 2548<br>106 | -3359<br>-626 | -425<br>210 | -2291<br>-466 | -2376<br>-720 | 1916<br>275 | -2881<br>394 | 1082<br>45 | 522<br>96 | -862<br>359 | 234<br>117 | -2909<br>-369 | -3470<br>-294 | -237<br>-249 | 570 |
| | -162 | -9513 | -3253 | -894 | -1115 | -983 | -1018 | | | | | | | | | | | | | | |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455  -4  -8455  -4
NULT  -4     -8455
NULE  595    -1558  85   338  -294  453  -1158  197  249  902  -1085  -142  -21  -313  45  531  201  384  -1998  -644
HMM    A       C     D     E    F    G     H      I    K    L     M     N    P    Q    R   S    T   V    W      Y
```

| | A | C | D | E | F | G | H | I | K | L | M | N | P | Q | R | S | T | V | W | Y |
|---|---|---|---|---|---|---|---|---|---|---|---|---|---|---|---|---|---|---|---|---|
| 530 | -44 | 1529 | -1543 | -420 | -3474 | -1398 | 1178 | -2010 | 1267 | -3171 | -894 | -93 | 1812 | 1470 | -3 | 134 | -87 | -1693 | -3342 | -793 | 571 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9354 | -10396 | -894 | -1115 | -225 | -2791 | * | * | | | | | | | | | | | | |
| 531 | -790 | -3381 | 2768 | 1433 | -3700 | -2112 | -1526 | -3453 | -351 | -3396 | -2472 | 693 | -1942 | 1798 | -639 | -776 | -1842 | -3002 | -3563 | -2876 | 572 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9535 | -10577 | -894 | -1115 | -701 | -1378 | * | * | | | | | | | | | | | | |
| 532 | -1843 | 393 | -1728 | -1178 | -3506 | -284 | 1690 | -3230 | 612 | -3222 | -746 | -122 | -2923 | 2326 | 2483 | -1741 | -503 | -1064 | -163 | -941 | 573 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9535 | -10577 | -894 | -1115 | -701 | -1378 | * | * | | | | | | | | | | | | |
| 533 | -1221 | -2434 | -4973 | -4343 | -1243 | -1226 | -3082 | -533 | -3953 | 2627 | 3217 | -3864 | -1616 | -3509 | -3736 | -3310 | -2572 | -1707 | -2834 | -2554 | 574 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9535 | -10577 | -894 | -1115 | -701 | -1378 | * | * | | | | | | | | | | | | |
| 534 | 1450 | -1930 | -4104 | -3491 | -1896 | -3556 | 2495 | 247 | -3149 | -1787 | -1138 | -3113 | -3617 | -2827 | -3053 | 1185 | 679 | 1734 | -2391 | -189 | 575 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9535 | -10577 | -894 | -1115 | -701 | -1378 | * | * | | | | | | | | | | | | |
| 535 | -4417 | -3969 | -6340 | -5980 | 3761 | -5864 | -3411 | -2532 | -5614 | 1659 | 101 | -5162 | -5604 | -4752 | -5220 | -5039 | -4311 | -774 | 953 | 65 | 576 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 536 | -2071 | -3283 | -6466 | -6137 | -3983 | -6276 | -6219 | 3157 | -6088 | -646 | -2689 | -5934 | -6035 | -6036 | -6240 | -5635 | -1188 | 2500 | -5658 | -5137 | 577 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 537 | -4698 | -6039 | -2358 | 3889 | -6557 | -4372 | -3888 | -6779 | -4115 | -6525 | -6046 | -3128 | -4945 | -770 | -4766 | -4363 | -4812 | -6239 | -6218 | -5631 | 578 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 538 | -307 | -3323 | -6487 | -6148 | -3826 | -6243 | -6121 | -154 | -6081 | 112 | -2550 | -5932 | -6005 | -5943 | -6184 | -5595 | -3805 | 3550 | -5492 | -5057 | 579 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 539 | -2025 | 293 | -4164 | -3541 | -1842 | -3549 | 1126 | 700 | 1261 | -753 | 2388 | -1249 | -3601 | -2842 | -1477 | -2625 | -412 | 2460 | -2339 | -1992 | 580 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 540 | -1563 | -3152 | -5842 | -5253 | -2458 | -5138 | -4100 | -1563 | -4909 | 2261 | 3761 | -4842 | -5002 | -4347 | -4664 | -4291 | 3 | 589 | -3613 | -3441 | 581 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 541 | 520 | -3326 | 1125 | 81 | -3645 | -63 | -133 | -3396 | -362 | -2267 | -2416 | -1447 | 2861 | -424 | -1577 | 322 | -1792 | -2947 | -3509 | -2825 | 582 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 542 | -130 | -2971 | -1951 | -1392 | -3156 | -2947 | -1611 | -2811 | 2278 | -2922 | 1553 | -1661 | 369 | 1369 | 1618 | -1876 | -1842 | 194 | 636 | -521 | 583 |

TABLE Z-continued

```
HMMER2.0 [2.2 g]
NAME  sel_kivd
LENG  562
ALPH  Amino
RF    no
CS    no
MAP   yes
COM   hmmbuild -n sel_kivd sel_kivd.hmm sel_kivd.aln.fa
NSEQ  170
DATE  Wed Apr. 25 16:17:47 2012
CKSUM 3974
XT    -8455   -4   -8455   -4   -1000  -1000  -8455  -4    -8455  -4
NULT  -4      -8455
NULE  595   -1558  85   338   -294  453  -1158  197  249  902  -1085  -142  -21  -313  45  531  201  384  -1998  -644
HMM   A      C      D     E     F     G    H      I    K    L    M      N     P    Q    R   S    T    V   W      Y
```

| | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| 543 | -149 | -500 | 233 | 43 | -381 | 399 | 106 | -626 | 210 | -466 | -720 | 275 | 394 | 45 | 96 | 359 | 117 | -369 | -294 | -249 | 584 |
| | -3 | -9513 | -10555 | -894 | -1115 | -701 | -1378 | * | * | | | | | | | | | | | | |
| 544 | 74 | -3147 | 1222 | 881 | -117 | -579 | 934 | -3118 | -466 | -379 | 3446 | -452 | -2917 | -1053 | -1594 | -945 | -1766 | -2737 | 3368 | 17 | 585 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | | | | | | | | | | | | | |
| 545 | -4169 | -6191 | 4038 | 285 | -6370 | -2745 | -3346 | -6411 | -3828 | -6222 | -5705 | -2453 | -4459 | -3051 | -4886 | -3763 | -4286 | -5829 | -6365 | -5255 | 586 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 546 | 1832 | -1886 | -4143 | -3522 | -1844 | -1044 | -2404 | 1737 | -853 | 91 | 950 | -3115 | -3598 | 598 | -3045 | -1244 | -143 | 564 | -2340 | 401 | 587 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 547 | -7151 | -6137 | -7088 | -7470 | -7647 | -6121 | -6786 | -8695 | -7673 | -8087 | -7998 | -7367 | 4335 | -7540 | -7140 | -7568 | -7423 | -8217 | -6429 | -7632 | 588 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 548 | 476 | -3285 | 36 | 1975 | -3605 | -2735 | 791 | -3355 | 1122 | -1411 | -2374 | -1424 | 1747 | -464 | -790 | -850 | -1348 | -282 | -3469 | -2787 | 589 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 549 | -1976 | -171 | -3149 | -2571 | -706 | -1143 | -2137 | -1639 | 827 | 2330 | -1286 | -2547 | -1485 | -598 | -1066 | 390 | -1226 | 283 | -2522 | -2133 | 590 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 550 | -4076 | -3935 | -6596 | -6196 | -2660 | -5489 | -5140 | -2143 | -5807 | 3215 | 1093 | -5660 | -5498 | -5016 | -5450 | -1793 | -1843 | -2804 | -4252 | -4308 | 591 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 551 | 1078 | -3286 | 369 | -606 | -3606 | -924 | 386 | -346 | 1531 | -1218 | -2375 | -784 | -1792 | 470 | 1582 | 287 | -1045 | -1330 | -3469 | -2787 | 592 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 552 | 870 | -3288 | 955 | 762 | -3609 | -2788 | -1447 | -3359 | 1869 | -3304 | -2377 | 575 | -2881 | 916 | -134 | -154 | 649 | -927 | -3471 | -2788 | 593 |
| | -149 | -500 | 233 | -894 | -1115 | -701 | 106 | -626 | 210 | -466 | -720 | 275 | 394 | 45 | 96 | 359 | 117 | -369 | -294 | -249 | |
| | -3 | -9513 | -10555 | | | | -1378 | * | * | | | | | | | | | | | | |
| 553 | -2451 | -2244 | -4811 | -850 | -4050 | -2788 | -2936 | 2017 | -3799 | 1315 | 1090 | -3697 | -2122 | -3398 | -3598 | -3147 | -2391 | 1908 | -2742 | -2425 | 594 |
| | -149 | -500 | 233 | 43 | 1617 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| 554 | 1760 | 1317 | -4381 | -3879 | -2618 | 1475 | -2979 | -2170 | -3574 | -503 | -1846 | -3366 | -3799 | -3267 | -2945 | 1023 | 1661 | -342 | -3089 | -2748 | 595 |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |
| | 469 | -203 | -307 | -441 | -3608 | -778 | -624 | -3359 | 2219 | -1751 | -2376 | -27 | 169 | 1274 | 1396 | -405 | -1753 | -2909 | -3470 | -2788 | |
| | -149 | -500 | 233 | 43 | -381 | 399 | 106 | -626 | 210 | -466 | -720 | 275 | 394 | 45 | 96 | 359 | 117 | -369 | -294 | -249 | |
| | -3 | -9513 | -10555 | -894 | -1115 | -701 | -1378 | * | * | | | | | | | | | | | | |

TABLE Z-continued

```
HMMER2.0 [2.2 g]
NAME   sel_kivd
LENG   562
ALPH   Amino
RF     no
CS     no
MAP    yes
COM    hmmbuild -n sel_kivd sel_kivd.hmm sel_kivd.aln.fa
NSEQ   170
DATE   Wed Apr. 25 16:17:47 2012
CKSUM  3974
XT     -8455   -4   -8455   -4   -8455   -4   -8455   -4
NULT   -4   -8455
NULE   595   -1558
HMM    A   C   D   E   F   G   H   I   K   L   M   N   P   Q   R   S   T   V   W   Y
```

| | | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|---|
| | | -3 | -9513 | -10555 | -894 | -1115 | -701 | -1378 | * | * | -84 | -1461 | -2220 | -573 | 48 | 1298 | 782 | -1879 | -10 | -2680 | -2251 | |
| 555 | | 2140 | 531 | -2674 | -2109 | -2303 | -1382 | -215 | -974 | -1956 | -466 | -720 | 275 | 394 | 45 | 96 | 359 | 117 | -369 | -294 | -249 | 596 |
| | | -149 | -500 | 233 | -894 | -381 | 399 | 106 | -626 | 210 | | | | | | | | | | | | |
| | | -3 | -9540 | -10522 | -894 | -1115 | -701 | -1378 | * | * | | | | | | | | | | | | |
| 556 | | -925 | 1036 | -4355 | -3719 | 2743 | -3561 | -2433 | 844 | -809 | 1845 | -352 | -3206 | -3611 | -2939 | -3117 | -2497 | 35 | -641 | -2298 | -1957 | 597 |
| | | -149 | -500 | 233 | 43 | -381 | 399 | 106 | -626 | 210 | -466 | -720 | 275 | 394 | 45 | 96 | 359 | 117 | -369 | -294 | -249 | |
| | | -3 | -9480 | -10522 | -894 | -1115 | -701 | -1378 | * | * | | | | | | | | | | | | |
| 557 | | 1679 | -3271 | -1635 | 1223 | -3592 | 210 | 597 | -3343 | -28 | -3287 | -2361 | 890 | -582 | 1048 | -1519 | 1028 | -1737 | -2893 | -3455 | -2772 | 598 |
| | | -149 | -500 | 233 | 43 | -381 | 399 | 106 | -626 | 210 | -466 | -720 | 275 | 394 | 45 | 96 | 359 | 117 | -369 | -294 | -249 | |
| | | -3 | -9456 | -10498 | -894 | -1115 | -701 | -1378 | * | * | | | | | | | | | | | | |
| 558 | | 1025 | -3243 | 803 | 28 | -3564 | -1358 | -1403 | -1721 | 374 | -3259 | -1543 | 1050 | 402 | 1597 | -146 | 737 | 186 | -1876 | -3426 | -2744 | 599 |
| | | -149 | -500 | 233 | 43 | -381 | 399 | 106 | -626 | 210 | -466 | -720 | 275 | 394 | 45 | 96 | 359 | 117 | -369 | -294 | -249 | |
| | | -3 | -9456 | -10498 | -894 | -1115 | -701 | -1378 | * | * | | | | | | | | | | | | |
| 559 | | -327 | -1900 | -605 | -1094 | 1259 | -2758 | -1418 | -3245 | 74 | -3213 | -2299 | -1401 | -1804 | 2740 | 2365 | -287 | -1717 | -2817 | -3399 | -801 | 600 |
| | | -149 | -500 | 233 | -894 | -381 | 399 | 106 | -626 | 210 | -466 | -720 | 275 | 394 | 45 | 96 | 359 | 117 | -369 | -294 | -249 | |
| | | -3 | -9443 | -10486 | -894 | -1115 | -701 | -1378 | * | * | | | | | | | | | | | | |
| 560 | | -2174 | -5296 | 1116 | -1204 | -5520 | -1310 | -2820 | -5404 | 45 | -5286 | -4551 | 3932 | -4039 | -2467 | -3701 | -3182 | -1194 | -4890 | -5474 | -4526 | 601 |
| | | -149 | -500 | 233 | 43 | -381 | 399 | 106 | -626 | 210 | -466 | -720 | 275 | 394 | 45 | 96 | 359 | 117 | -369 | -294 | -249 | |
| | | -3 | -9403 | -10445 | -894 | -1115 | -701 | -1378 | * | * | | | | | | | | | | | | |
| 561 | | 212 | -859 | -622 | -707 | 493 | 653 | -1369 | -3227 | 1180 | -3187 | -2268 | 762 | -2803 | -913 | 308 | 1455 | -263 | -1536 | -3366 | 947 | 602 |
| | | -149 | -500 | 233 | 43 | -894 | -701 | 106 | -626 | 210 | -466 | -720 | 275 | 394 | 45 | 96 | 359 | 117 | -369 | -294 | -249 | |
| | | -5 | -8809 | -9851 | -894 | -1115 | -701 | -1378 | * | * | | | | | | | | | | | | |
| 562 | | 1180 | -2467 | -1321 | -427 | -2668 | 2005 | -1030 | -1181 | 303 | -2431 | -1589 | -1053 | -1043 | -623 | 100 | 231 | -1262 | -487 | -2727 | 840 | 603 |
| | | * | * | * | * | * | * | * | * | 0 | * | * | * | * | * | * | * | * | * | * | * | |

SEQUENCE LISTING (417 sequences)

SEQ ID NO: 1 - DNA, 1647 bp, Artificial sequence
  Lactococcus lactis sequence codon optimized for E. coli
atgtacaccgttggcgactatctgctggaccgcctgcacgaactgggcatcgaagagatttttggcgttccgggtgattacaacctgcaatttctggaccagatcatttcccacaaagacatgaaatgggtgggtaacgcgaacgagctgaatgcgagctacatggccgacggctatgcccgtacgaagaaagccgctgcatttctgaccacctttggtgtcggcgaactgagcgcagtcaacggtctggcaggctcctatgctgagaacctgccagtggtggagattgtgggctcgccgactagcaaggttcagaacgagggtaaattcgttcatcatacgttggcggacggtgacttcaagcacttcatgaagatgcatgaaccggtcaccgctgcgcgtacgttgctgaccgctgaaaacgccactgtggaaatcgatcgtgtgctgtctgccctgctgaaagaacgtaaaccggtgtatatcaatctgccggtcgatgttgcagccgcgaaggcagagaaaccgagcctgccgctgaagaaagaaaatagcaccagcaatacctctgatcaagaaatcctgaataagatccaagagtccctgaaaaatgcgaagaaaccgatcgttattaccggtcacgagatcatcagcttcggtttggagaaaaccgtgacgcagttcatttccaagaccaagttgccgatcaccacgttgaactttggtaagtctagcgtggacgaggcgctgccgtcttttctgggtatctacaatggcacgttgagcgaaccgaatctgaaagagtttgtggagagcgctgatttcattctgatgttgggtgttaagctgacggactctagcaccggtgcgttcactcatcacctgaatgaaaacaagatgattagcctgaacattgatgagggcaaaatctttaacgagcgcatccagaattttgattttgagagcctgattagcagcttgctggacctgagcgagattgagtacaagggtaagtatattgataagaaacaggaagatttcgtcccgagcaacgcgctgctgtcccaagatcgtctgtggcaggccgttgaaaacctgacgcagagcaacgaaaccattgtggcggaacaaggtaccagcttctttggtgcaagcagcatttttctgaaaagcaagtcccactttatcggtcaaccgctgtggggtagcattggctacaccttcccagcagcactgggtagccagattgcagacaaagagagccgccatctgctgttcattggcgacggcagcctgcaactgacggttcaagagctgggtttggcgattcgcgaaaagatcaatccgatctgcttcatcatcaataacgatggttacaccgtcgagcgtgagatccacggtccgaatcagtcgtataacgacattccgatgtggaattacagcaaactgccggagagcttcggtgcgacggaggatcgcgtcgtcagcaaaattgtgcgtaccgaaaacgagttcgtcagcgttatgaaagaagcgcaagcggaccctaatcgtatgtactggattgagctgatcctggcgaaagaaggcgctccaaaggttttgaaaaagatgggcaagctgttcgcggaacagaacaaaagctaa

SEQ ID NO: 2 - DNA, 1653 bp, Artificial sequence
  Erwinia amylovora sequence codon optimized for E. coli
atgtccacctacaccgtcggcgactatctgctcacgagactcaatgagattggtatttcgcacttgttcggtgttccaggtgactataatctgcgttttctggaccatgtgatcgaccacccggatgtcgattgggtcggctgcgcgaatgagttgaatgccgcttatgcggcggatggttacgcccgctgtcgcggtgcgggtgcactgctgaccacgttcggtgtcggcgagttgagcgcgatcaacggtgttgcgggtagcagcgcggagtatctgccggtgattcatattgtgggtgccccgtcgcagactagccagaacaaaggcgagctgctgcaccacactttgggtgacggcgacttcggtcatttcattcgcatgcagcaagagatcagcgtggcgtccagcgtgctgactaccgcgaatgcggcagcggagatcgaccgtgttctgtttgaagcgctgaccaagcgtcgtccggtttacctgctgctggcgaccaatgtggcagagagccctctgagcccgcctagctctccgctggaactgcgtttggattgcgataaagcgcagctggcggcatttgttgacgcagctgaatctctgctggctccggcatccagcgtggctatgttggccgactttctggccgatcgcgcgcaacaacagcagcgcttgcagcgttggctggaagagattccgatgccgttcgccacgctgctgatgggcaagtccgttctgccggagatgctgaccggttttgttggcacgtacgcaggtgcggccagcgccgatagcacgcgcgctgttattgaaaacagcgatgtcctgatcagcgtcggtgtgcgctacacggatagcatcacggcaggcttcacccaacagatcacgtgctctaaaaacatcgatgtcggcctgcacagcagctcggtcgcgggtcagccgtttgagccggtgccgatggctgccgcgttggaagccctgtaccaactggcgcgcaagtacggtcaaggctggcaacgcggtattgttgcaccgccggtcagcgaagaacagagctctgacggtttgacgcaagacaccttttggcatgccctgcaagattttctgcgtccgggtgatatcgtcctggcagaccaaggcaccgctgcgttcggcgcagcggcgctgcgtctgccgcaagacgtccgtctgctggtgcagccgctgtggggcagcattggttacaccctgccggctgcattcggtgcacagaccgcacgtcctcaacagcgcgttgttttgattatcggtgacggcagcgcgcagttgaccgtgcaggaactgggttccattctgcgtgacggtcagaaaccggtgatcttcctgctgaacaatgatggctataccgtggagcgtgcgatccacggcgcacaacaacgttataacgatatcgcgcgttgggactggacgcgtttgccgcagaccctgggcattgatagcctggcgcaaagctggcgtgttacccagaccgtgcagctgcgtgaagttatgaagctgctgcaagagggtggtcatctgagcctggttgaggttgttctgccgcgtctggacgtcccgccactgctggccagcgtgtgtcacgcgctgaaccagcgtaataacagctaa

SEQ ID NO: 3 - DNA, 1629 bp, Artificial sequence
  Thauera sp. MZ1T sequence codon-optimized for E. coli
atgaatctgacggaatccctgctgcacgccctggtcgatcacggcgcacgccagatcttcggtatcccaggtgattttgcgctgccgtacttccgtattatcgagcagaccggtattctgccgctgcacaccctgtcccatgagccgggtgttggcttcgcggcagatgctgccgcacgtgtgcagggtggcattggcgtggcagcggttacctacggtgcaggcgcgctgaatatggtcaacgccgtcgctgctgcatacgcggaaaagagcccgctggttgtgatcagcggcggtccgggcctgggtgaaagccaaagcggcctgttgctgcaccaccaggcgaaaacgttggacagccaactgcgcatcttccaagaaattacctgcgatcaggtccgtctggacgatgcggctcgtgcaccggcagacattgcgcgtgtcctgggcaactgtgtgcgtaacagcttgccggtgtatatcgagattccgcgcgatatggttgcgcgtccgtgtgctccggtcgtacgtgaagcgccacgtgcggttgatgcggacgccctggcagcatgcgtggacgagatcctggcgcgcttgcgtgctgcacgtgcgcctgtcctgatggcaggcgttgaggtccgccgcttcggtctggaggacaaggtggccgagctgagccgtcgtctgggcatcccggtcgttacgagctttatgggtcgcggcctgctggcagatcaagatgccccgctgatgggcacgtacatgggtctggccggtctgccggaagtttcggcgctggtcgaggacagcgacggtttgtttctggtgggcgtgatcatcagcgacactaactttgccgtttctggtaaacatattgatctgcgtcacaccatccaggccctggaggctcgcgttactatgggctaccacacctacgcggatattccgctggatgctctgattgacggtctgctggcccgtgtgccgcacgcggatgcgcattttaccgtggaccgtcctgccttcccgcatggcttgcaggcggacgaagcaacgattgcaccggcggacatcgcctgtgctgtcaacgacctgatggctgcgcatggtaagctgccaatcgcgagcgatatgggtgactgcttgttcaccgctatggatattgagcacacggcactggtcgcaccgggctattatgcgaccatgggttttggtgttccggcaggtttgggtgtgcaggcagcgacgggtcaacgtccgctgatcctggtgggtgatggtgcgtttcaaatgaccggctgggagctgggtaattgccgtcgctatggttgggatcctattgtgctgctgttcaataacgctagctgggagatgctgcgcaccttccaaccggagagcggctttaatgacctggacgactggggttttgcgcagatggcagcgggtctgggtggcgacggcgtgcgtgttcatacgcgtgcccaattgaaagcagccctggacaaggccattgcgacccgtggtcgcttccagctgatcgaagttatgattccgcgtggtgttctgagcgaatccttgtctcgtttcgttaacgcggtcaaacgcctgaatgcggcgaaagcggcttaa

SEQ ID NO: 4 - DNA, 1653 bp, Artificial sequence
  Frankia sp. Eul1c sequence codon-optimized for E. coli
atggtcaccacggtaatccaacacgtcctgaaccgcctgcgcgacttgggcatccgccacgtgtttggtgttccgggcgattacgccttcccggttgacgacgcggtcattgcacacccggatatccagtggatgggtaactgtaatgagctgaacgccgcatattgtgcggatggttatgcccgtgtgcatggcatgggtgcagtgagcaccacctatggcgttggcgaactgtcggcaatcaacggcattgcgggtgcgtacaccgaacacttgccagtgtttcatctggttggcatgccgaaaatgccggttcaggcccgtcacgcgctggtgcaccacaccctgggtaacggtgagttcgatttgttccagcgtatgagcgacccggtcgtgtgtgcatcggcgattatgactccgcaaaacgtcgccgcagaaaccgagcgcctgattgcggcagcgatttaccaccgtcgtccagtgtatctggcctttccggccgatctggccgaactgccggttgcgagcgaggctccggagctgccggcaccggcgagcgatccggctcaactggacgctgcggttgcggcggtcgcagatcgtctgcgtcatgctggcagcgcgtgcctgctgcctggtgcactggcggtgcgtgccggcctgggccgtcatctgcaacgcctggtcgacgccagcggtctgccgtttgcgacgatggtggcagataaaggtgtgctggatgaagatcagccgggctttgtcggcatgtacgacggcaagctgatgaatgaggatgtgcgccgcttggttgaagatggtgatgtggttgtgctggttggtgctttgatgcatgacttcaatagcggtgcgttcaccgcaaatctggacccggcacgtaccgtggacattcgccaccaccacgttcaggttggtgcaatgacgtatcctagcgtggagatgcgcgacctgctgacggcactggcagcacgcctgccgacccgtacgtggccgcgtcctagcgcaggtgtcgtccgtatgcgttccgaaccgggttccggcgatgacccgctgactgcgggtaccctgtatccgcgttgggagcgttttctgcgtccgcgcgacatcgttgttgccgagactggtacctgctccatgggtatggcgttcgcgcgtctgccgtacggcgcgaccttcgaaaatcagacgctgtggggtagcattggttgggcgacgccggctgcggtcggtgccgcggtcgccgctggtccggatcgtcgtgtcgtgctgatcaccggtgagggtagccaccagctgacggcgcaagagatctctcaattcggccgttaccgcttgcgtccggtcgtgtttgttctgaataacagcggttacctgattgaacgcctgctgtgcaagcacccggatctggcatacaatgacctggcccgttggcattacgcggaactgcctcgcgtgctgggttgcgaggactggttcaccgcgcgtgttagcacctgcgcggaactggaccgtgcgttggacaccgctcgtcacgcgtctacgggctgttatatcgaggttctgacggacagccatgcggctccaccgttggcgacccgcatgcatgagaacttgggtagcctgtacgcgggctaa

SEQ ID NO: 5 - DNA, 1722 bp, Artificial sequence
  Acinetobacter sp. RUH2624 sequence codon-optimized for E. coli
atgttcatcgagatcggcgagttccttaacctgcgcttaaaacaaatgggcatccaacacctgttcggtgtcccgggtgacttcaacctgagctacctggagcaggttgaggcggatccacaattggagtttattggtaattgcaacgaattgaatgccgcttatgcggcggacggctatgcgcgtattaacggcttctctgcgctggcgactacctacggtgtgggtgatctgtccgcgattaatggtattgccggtgcgtacgcggaaaatgtgccgctgattcatattagcggcattccgccgttgcatgccgtgcagaaaggtaccctgattcatcacaccctggttgacggtaattacgacaatatcatgaattgcatgaaagaatttacggtcgctcagacccgcttgaccccggcaaatgccgcatctgagatcgaccgcgttctgcgtcagtgcttcttggaacgtcgtccggtccacatccagctgccgggtgatattactcacgtcaagatcgaggtcagcgagcgtccgctggacctgagctatccggcggtggagccggagctgctgcaatctgttgtgtccaaactgtgtgacattatcgagaacgcgcagtcgccggctttgctgattgataacgaggcaagcgttttcggcgtgaccagcctgctgaatgacctgagccagaagtgtagcatcccgttcgcgggtatgaacacggccaagaacattatggatgagggctcccctcgctacatcggtacgtatgtcggtggcgccagccagccgcacgttaagaatatcattgaacaaagcgactgcttgatcggcatcggtgcgcgttttaccgacgttggcagcgcggtgtttacgcatcagattgaaacccgcaattacatcgaaatcaagtcctacggtctgaacatcttcggtcaggattttccgggtattgaaattggccagctgctggtcgaactgaacaagaaagttgcaccgcgcaagagcagcgttccgctgttggaaaaacagccgcaaaaagtggtggaggcccctgcgcagcaacgtttgagccaggatgtcctgtggaattacattagcggttttctgaaagaggatgatgtaatcatcggtgaggtaggcacgtcgaatagcgccctgtctggtatcaaactgccggctacggcgaagtacattgcacaaccgctgtggggtagcattggctatacgctgccagccctgctgggtagcctgctggcagcaccggagcgtcgccaaatcctgtttatcggtgatggtagcttccaactgaccgtccaggagctgtccacgattatccgtcacggcctgaagcctatcattttcctgctgaacaacggcggttataccattgaacgtctgatcatgggcgagaacgcagcttacaacgacgtgcagaactggaagtacaccgagattccggcggttttcaatggcaagaagggccacactacctacgtcgttgaaaccgcaggtcaactgaagagcgttctggacaatgtgcagcaaaacgaccaattgacctttatcgagctgaaactgccagcgatggacgcaccggtgagcctgaaaaagttcgcatcggttattgcgcgttttgactatggtgatcgtggttatgaaattctgaaagaacgtagccaaccgatcaaatgtaaagatgcgagcagcttttaa

SEQ ID NO: 6 - DNA, 1626 bp, Artificial sequence
  Anabaena variabilis ATCC 29413 sequence codon-optimized for E. coli
atgccgcaattagccccacacatcttcgacatcctgtaccaaaagggtgttgagcacgccttcggcattccgggcgacttcgcgctgaccttgtttgatgcgctggctgatagcaaaattgcaccgatcgttatgacccacgaaccgtgcgtgggcttcgcggcagatgcttacagccgtatgcgcggtctgggtctggcagttgttacgtattctgtgggtggtttgaatatggtcaatgcggtcgccggtgcgtatgcagagaaatctccgttggttattctgagcggtggtccgggtgtccgcgaacagaaagagcacgatctgctgcaccacaaggtgaaaaccttcgatacgcaacgtcgtgtgtacgaagaagtaactctgtacgcaacgaaactgaccgacccgaaaaccgcggatgcaaagatccatcatgcgctggattatgcgactacgtttaaacgcccggtctatttggagatcccgcgtgacttggtttatgctgagatcaccgaatccgaacatctgcctccgccgattaaacgtaccgacccggatacgctgaccgaggctattgccgaaaccctggaaatgctgaaacgcagccacagcccggtcattttggcgtgcgtcgaggtgcatcgtttcggcctgcaagaacagttgctggcgctggcggaaaagctgggtgttccagtctgttccactatgctgggtaagagcgtctttccggagcgccacccgcagtatatcggtatctacaatggcgaggccggtgacctgaacgtccagaagattgttgaagagagcgactgcgttttgatgctgggtgtgttcatgaccgacatcaatttgggcatgttcactgcgcatctgaatccgggctttaccgtgtatgcgaccagcgagcgtctggcgattaaacaccacgagtatccaaacgtgcgtttcgaggactacattacgacgctgctggacagcccggatctgccgcactgggactccagcggtatttacaccatgaagccgcgtgttacgccgagcgttggtaagatctctatgagcggtctgctgtacgagctgaatcagttcattgatagcaacaccctgctggtgacggacgtgggtgatgcgctgtttgcggcggacgacatccaaacgcaacagggcaccagcttcctgtgtccggccttttacgcgagcatgggctttggcgtgccgggtgtgattggcgcgcaactggccgacccgtcgcgtcgtgcaatcgcactggttggtgatggcgcatttcacatgacgggtatggagctgctgacggcgcagcgcctgcgcctgaaccctattgtcatcgttatcaacaacggtagctttgcctcgctgcaagctatgggccatcaggaagcggcgtttgtgcagatcccgaccatggattacgctcaactggcaaacgtcctgggcggtcatggctttgttatccacacctccacccagttgcagcaggccctgcaaaccgcccagaatagcaagaccttcagcattctggacgtgcatctgagcccggacgatgtcagcccagctctgcaacgtctgagcgcattgttcaccaagagcctgaaaggttaa

SEQ ID NO: 7 - DNA, 1725 bp, Artificial sequence
  Mycobacterium kansasii ATCC 12478 sequence codon-optimized for E. coli
atggtaagcgcaggcagaacggtagtattcgtcaccgatcgcgcggcaggtccgaatgagccggtctacactgtcggcgactacctgctggatcgtctggcagagctgggcgtgagcgaaatctttggtgttccgggtgattacaacctggagtttttggaccatattgtggcgcatccagcgattcgttgggtgggcaatgcaaatgaactgaacgccggctatgcggcggacggttatggtcgtctgcgcggcatgagcgccgttgtgaccacgtttggcgttggcgaactgtccgcggcaaacgctatcgcaggttcttatgccgagcacgtgccggtggttcacattgttggtggtccgagcaaagacgcacagggcacccgtcgcgcactgcaccacagcctgggcgacggtgacttcgagcatttcttccgtatcagccgtgaaatcacctgcgcccaagccaatctgatgccggcgacggcgtgtcgcgagattgaccgtgttctgtgcgaagtccgcgagcagaagcgtccgggttacctgctgctgagcactgacgtcgcgcgtttcccgaccgaaccgccaggtgccccgctgccgccgtatggtggcggtacgagcccgcgtgcactgtcgttgtttaccgaggctgccgcagccctgatcggcgaacatcagctgaccgtgttggcagatctgttggtgcatcgtttgcgcgcagttgatgaactggaggccctgctggcggctgacgtcgtcccgcacgcgacgctgatgtggggtaaatctctgctggatgagtccagcccgaatttcttgggtatctacgcaggtgcagcgagcgccgctcgcgtgcgtgcggcgattgaacaagccccggtcctggtcacggcgggtgtcgtgtttactgacatggtttcgggtttcttcagccaacgcattgatccagcacgtaccatcgacatcggccaataccagagcaccgtggcgggtcgtgtgtttgcgccgctggagatgagcgccgctttgcgtgctatcgcggagatcctgaccggtcgtggcattaccagcccgcctgttccggctccggatgatcaccgtccggcaagcacgccacaacgtgacgatccgctgacgcagcgtatgctgtgggaccgcgtgaacgatgcgctgaccccgggtaacgttgttctggcggagcagggcaccagcttttatggcatggcggatcaccgtttgcctcacggtgttacctttattggccagccgctgtggggctctatcggttacacgctgccggctgcgctgggtgccgcggttgcgcaccgcgaccgtcgtaccgtgctgctgattggcgacggtgctgcgcagctgacggtgcaagagatcggtaacttctcccgtgagggtctgagcccggttattgttgtggtcaataacgacggttacaccattgaacgtgctatccacggtgaaaccgcgagctataatgatattgcggcgtggtcttggacggcagtgccgagcgcgctgggtgtcaccgatcatctggcgttccgtgcgcgtacctacggcgaactggatgacgcgctgaccgcggcagccgcgcatcgtgaccgcctggttctggttgaagctgtcctgcctcgcctggagattccgcacttgttgagcgacctggtcgcaccgaccagctccgatggtacggcacgccgctaa

SEQ ID NO: 8 - DNA, 1647 bp, Artificial sequence
  Listeria grayi DSM 20601 sequence codon-optimized for E. coli
atgtacaccgtcggccaatacttagtagaccgcttagaagagatcggcatcgataaggtttttggtgtcccgggtgactacaacctgacctttttggactacatccagaaccacgaaggtctgagctggcaaggtaatacgaatgaactgaatgccgcgtacgcagctgatggctatgctcgtgaacgcggtgttagcgctttggtcacgaccttcggcgttggtgagctgtccgcaatcaatggcaccgcaggtagcttcgcggagcaagttccggtgattcatatcgtgggcagcccgaccatgaatgttcagagcaacaagaaactggttcatcacagcctgggtatgggcaactttcacaacttcagcgagatggcgaaagaagtcaccgccgcaaccacgatgctgacggaagagaatgcggcgtcggagattgatcgtgttctggaaaccgccctgctggagaaacgcccagtgtacatcaatctgccgatcgacattgctcacaaggcgatcgtcaagccggcgaaagccctgcaaaccgagaagagctctggcgagcgtgaggcacaactggcggagatcattctgagccatctggagaaggctgcacagccgattgtgattgcgggtcacgagatcgcgcgcttccagatccgtgagcgtttcgagaattggattaatcaaacgaaactgccggtgaccaatctggcctacggcaagggtagcttcaacgaagaaaacgagcatttcattggtacctattatcctgcatttagcgataagaacgtgctggactacgtggataactccgactttgtcctgcactttggtggtaaaatcattgataacagcacctccagcttctcccaaggcttcaaaaccgagaacaccctgactgcggcgaacgatatcattatgctgccggacggtagcacgtattctggtattagcctgaatggcctgctggccgagctggaaaaactgaatttcacgtttgccgacaccgcagcaaagcaggcggagttggcggtgtttgagccgcaggctgaaaccccgttgaaacaggaccgttttcaccaggcggtgatgaattttctgcaagctgacgatgtcctggttacggaacagggcacctcttcttttggcttgatgctggcgcctctgaaaaagggtatgaacttgatctcgcaaacgctgtggggtagcattggttacacgttgccggcgatgattggtagccaaattgcggcaccggagcgtcgtcatatcctgagcattggtgatggtagctttcagctgactgcgcaggaaatgagcaccattttccgtgagaaactgaccccagtcatcttcatcattaacaatgatggctataccgttgagcgtgcgatccatggcgaagatgaaagctataacgacattccgacgtggaacttgcaactggtggcggaaaccttcggtggtgacgccgaaaccgtcgacactcacaatgtgttcacggagactgatttcgccaacaccctggcggcaattgacgcgacgccgcagaaagcacacgttgtggaagttcacatggaacaaatggatatgccggagagcctgcgccagatcggtctggcactgtccaagcagaatagctaa

SEQ ID NO: 9 - DNA, 1686 bp, Artificial sequence
  Bacillus thuringiensis IBL 200 sequence codon-optimized for E. coli
atgatccatctgaagaaacaatacaccgtgagcacctatctgctggaccgtctgcacgagctgggcattgaacacatcttcggtgttccgggtgactacaacctggcattcttggacgatgtcgttgcgcacgagaatctgaaatggattggtaattgcaacgagctgaatgcggcctatgcggccgacggttacgcccgcattaaaggcatcgcagcgttgatcaccacgttcggcgtgggtgagctgagcgccatcaacggcattgcaggtagctacgcggagaatgttccggtgattaagattaccggcactccgccgaccaaagttatggagaatggtgcaattgtgcaccataccctgggtgatggcaagtttgatcatttttctaacatgtaccgtgaaattactgtcgctcaaacgaacgtcacgccggagcacgcagctgaagagattgatcgtgtcttgcgtgcctgttggaatgagaagcgtccggttcacattaacctgccgatcgatgtctacaacaagccgattaacaagccgaccgagcctattctgtacaagcaaattctgagcaataaagaggcgttggacaaaatgctgctgcacgcaaccagcaagatcaagaacgctaagaaaccggttatcctggctgattttgaagtcgatcgcttccacgcgaaagaaaacctgcatcagttcgtggagaaaaccggtttcccgatcgccaccctgaatatgggcaaaggtatctttccggagaaacatccgcaattcatcggcgtgtatacgggtgatgtttccagcccgtatctgcgtaaacgcatcgacgaaagcgactgcattatctcgattggtgtcaagctgacggataccatcacgggtggctttacgcaaggttttaccaaagaacaagttattgagattcatccgtacacggttaagatcatcgataagaagtatggtccggttgtcatgaaagacgtactgcaacagctgtccgatgtgatcgaacaccgcaacgaagaaaccctggacattaagccattcatcagcgagagcctgagcattacggaagagttcaacccgaaagagcagatgattacgcagaagcgtttctggcagcagatctatcacttcctgcatgagaatgacatcctgattgcggagcaaggcacgccgttctttggctcggcgaccattccgctgccgaacaataccacctatgttgcgcagccgctgtggggtagcattggttacactctgcctgcgctgttgggcacccaattggcgaacctgagccgccgtaatatcctggtgatcggcgatggttcttttcagctgactgttcaggaactgtccaccattctgcgtcaaaatctgaagccgattatctttctgattaacaacaatggttatacggtcgaacgtgcaattcgtggccagaatcagccatacaacgacatccagatgtgggactacaccaaattgacgaacgtgtttggtaccgaagagaaaagccagaccttcaaagtggaaaacgaaacggagttggcggaggtcctgaccaatatcaccttcaacaaaaatcaactgatctttatcgaagtgattatgagccaaagcgaccagccagaactgttggcgaagctgggtaagcgctttggtcaacagaatagctaa

SEQ ID NO: 10 - DNA, 1641 bp, Artificial sequence
  Staphylococcus epidermidis M23864:W1 sequence codon-optimized for E. coli
atgaaacagagagtgggccaatacctgatggacgcagtatacgccgctggcgtcgataaggttttcggcgtgccgggtgatttcaatctggcgtttctggatgatatcattagccacgaccacattgaatggattggtaacacgaatgagctgaatgccagctatgctacggatggttatgctcgtattaacggcctgggtgcaatggtgacgaccttcggcgtgggtgaactgagcgcggtcaacggcatcgctggcagctacgcggaacgtgttccggtcatcgcgatcaccggtgccccaacccgtgcggtggaagaggccggtaagtttgtccaccatagcctgggtgagggtacctttgacgactatcgtaaaatgtttgaaccgattaccaccgcgcaaggctacatcaccccggagaacgcgacgaccgagattccgcgtctgattaacgcggcaatccaagaacgtcgcccggttcatctgcatctgccgatcgatgtcgcgctggcggaaattgaggtaagcgaaacgtttcagccggaggcactgcctcagcaagacgtccagaagtacgttaacatgattgaggacaagttgaagagcgcgtcgcagccgctgattattgcgggtcatgaaatcaacagcttcaatctgcacgaagagttggaagagatcgtggatcgcacgaacatcccggttgtgcagttgtctctgggtaaaggtgccttcaatgaagagaacccgcactacgtgggtatcttcgacggtgagattgcggaggacaagattaaagaatatgtcaataacagcgatgcgattctgaatatcggcgcgaaactgactgattccgcaaccgctggctttagctaccagtttgacatcgatgacgtggttatgatcaaccacaaaaactttaagatgaacgataccgttgcgaatgatgtgaccttgcctagcctggtgcacgcgctgaagggtctgaacttcaaaaatgagaacgactatccgcaatatgagcgtccgcaggcgcacaattacgagctgaataatcagccgctgacgcaagaaacctacttcaatatgatgcaggacttcatccaactggatgacgttctgattgccgaacaaggcacctctttctttggtgcgtatgatctggcgctgtacaaagataacaccttcattggccaaccgctgtggggctccatcggttacacgctgccagcaactttgggtacccagatcgcaaatccgcatcgccgcaacgtcctgctgattggcgacggtagcttgcaactgaccgtgcagagcttgtccactatgatccgtcaagacctgaaaccgattatcttcgtcatcaacaatgatggctacaccgtcgagcgtatgattcatggtatgaaagaaccgtataatgacatcaagatgtgggactataaggcgctgccggctgtttttggtggtgataacgttgccgtgcacgacgttaacaatagcgaagagctgatgcaggcgtttgaggacatcaaagcccacaatgaccgcatgcactacgttgaggttaagatggcagtcgaggatgcaccgacgaagctgagcgagattgccaaagcattcgcatcgcagaacaaataa

SEQ ID NO: 11 - DNA, 1686 bp, Artificial sequence
  Mycobacterium avium 104 sequence codon-optimized for E. coli
atgacggacgcagcaacggagccagcatacacggtgggcgactacttgctggatcgcctggcggaactgggtgtgagcgagatcttcggtgttccgggcgactacaacctggagtttctggatcacatcgttgcgcatccgcgcctgcgctgggtgggcaacgcgaacgagctgaacgcgggttacgccgcagacggttatggtcgcttgcgcggtatgagcgcactggttacgacttttggcgtgggtgaactgtctgcggcgaatgcagttgccggttcctatgcggaacaggtcccggtggttcacattgttggcggtccgtccaaagacgcgcagggtacgcgtcgtgcgttgcaccatagcctgggtgacggcgacttcgaacactttttccgcgtcagccgcgaaattacctgcgcccaggccaacctgatgccggcgactgcccgtcgcgagattgatcgcgttctgagcgaggtgcgtgagcaaaagcgtccgggctatattctgctgagcaccgacgttgcgcgttttccgaccgaaccgccggaagcggcgctgccgcgctataccggcggtaccagcccgcgtgcactggcgatgtttaccgaggcagcagcggcactgattggcgagcaccgtatcaccgtcctggccgacctgctggttcatcgtttgcaggcgatcaaagaactggaagccctgctggcagccgatgtggtcccgcacgctacgctgatgtggggcaagagcctgctggacgagagcagcccgaatttcctgggtatctacgcaggttccgcgagcgcaccggccgttcgtactgcaattgaagaggcgcctgtcttggttacggccggtgtagtgtttaccgatatggtgagcggtttctttagccaacgtatcgatccggctcgtacgattgatgttggtcaatatcagagctcggtggctggcgaggttttcgctccgttggagatgggcgaggcactgcaagcgctggcggcgatcctgacgcgtcgcggtgttagctccccgccagtcgcatctccgcctgcggaaccgttgcctccgccaccgcctcgtgaacagccgctgacccagaagatggtttgggatcgtgtgtgtaccgccctgactccgggcaatgtggtgttggctgatcaaggtaccagcttctacggtatggcggaccatcgtttgccgcaaggtgtcaccttcattggtcaaccgttgtggggctctattggctataccctgccggcagcactgggtgcggcggtcgcgcacccggaccgccgtacggtgctgctgatcggtgatggtgcggcccagctgaccgtccaggagctgggcacgtttgcgcgtgaaggcttgagcccggtgatcgtagtggtgaataatgatggttacaccgtcgaacgtgcgatccacggtgaaaccgcgccatacaatgatattgttggttggaaatggaccgaggttccgaacagcctgggtgtcaccgaccacctggcattccgcgtccagacctacggcgagctggacgacgccctgacggcggcagcgcgtcatcaagaccgtatggtcctggttgaggttgtcctgccgcgtctggagatcccgcgtctgctggtggagctggtccgcccgaccagcccggatggcagcccacgtcgttaa

SEQ ID NO: 12 - DNA, 1671 bp, Artificial sequence
  Psychrobacter arcticus 273-4 sequence codon-optimized for E. coli
atgtcccagcaatacaccatcgccgactacctgttcgaccgcattgcggaggccggtgcgtccgaagtgtttggcgttccgggcgacttcaacctgacgttcctggataacattatcgcgagcgacaaactgcgctgggtgggtaatactaatgaactgaatgcgggctatgcagcagacggttatgcgcgtgaacgtggcttcgccgctatggttacgacctttggtgtcggcgagctgagcgccatcaatgcgacggcaggcagcttcgcggaatacgcaccggtcctgcacattgttggtgcccctagcacggcgctgcaagactctaaacgtcgcatccaccactccctgggtgatggtgtgtttaaccatttcatcaaaatggtggagccggtcaccgtggcacgtgcgcagattacgccggagaatgcggcgtccgagattgaccgtgttattcgtctgattctgaagaagcatcgtccaggttacttgatgctgagcccggatgttgcgcgccagccgatttatccaccgaccactaagttggttgatagccaagaggatatcaccagccaagcggcactggcggactttaaacaggcgctgattgcattcctgccgaacaagaccacgacgctgatggctgacctgatggtccaccgcctgggtttgcaaaatcaactgaaagccctgatcgcagataccgatatcccttacaccacgctgagctggggtaaaacgctgctggatgaaaatagcgatcgctgggcaggtacgtatgcgggcgtggcgagccgtccggtggtgaaagatgcggtggagaactgcgagtgtttgatcaaaattggtgttcagtacacggacaccaccaccgcgggtttttctcaggatattgacgagaacgtcgtggtcgatctgcattacgagcgtgcttctatcgcgggtaagaactttgctccgatcgcgttgaaagacgctctgaaaaccctgcatgaggtgatgaccagcgacattaacatcgtcccgaagcagttctataaagaggttaaaccgcacgaacagcacggcaaagacaacgaagcaattcgtcaggacgatctgtggcacatcatcgcggatcatctggatcataacaacctggtttttgccgaacagggcaccgcatatttcggcatcagcgacgtacgtttgccggagggtgttacctgttacggccagccgatgtggggtagcatcggttacaccctgccggcgagcctgggtgccgctattgctagcccgtcgaagcgtagcgttctgctgatcggcgacggtagcgccctgctgactattcaagagatcgctgtgatgattcaggagcgcattaacccggtcatcgttctgatcaataatgacggctatacggttgagcgcgcgatccacggtgaaaatcaacgttacaatgatattccgaagtgcgactggcaagcgatgccgaaagcctttggcgccaccgaagaaaactcgctgatgctgaaggtcgcgaccgccggtgagttgaaggccagcctggaaaaggcagcagcaaccaccgataagctggtgatgctggaagtcattgcggcaaagcacgatattccaccgttgttggcggacattagcgcagcgctgaagccgaaagcggactaa

SEQ ID NO: 13 - DNA, 1674 bp, Artificial sequence
  Corynebacterium striatum ATCC 6940 sequence codon-optimized for E. coli
atgcaaaccaccgtcggcgaattcatcctggaccgcttgaaagcaattggtatcagcgagatcatcggcgtcccgggtgacttcaatctgtcctttctggaacagattgacgaagcggaaggtattcgcttcgtaggtgcgtgcaatgagctgaatgccgcctatgcggcagacggttacgcacgtcaacgtggcgttggttgcctgttgacgacctatggcgtgggcgagctgtctgcgctgaatggcattgccggtgcacgcgcggagcacgtcccgctggtgagcattgctggcgcaccgccgcaatacgcgaccgagtttcgttggaacttgcaccacaccctggctgacggtgattttgcgaacatgctggacgccattgccccgtttaccgaggttgcgacgcgtgttagcccgatgaacgtggtggaagagttcgatcgcgctctgcacacgtgtctgcgtgaaaaacgtccagtgcatattcagatcccgtcggacatcacccatctgacgatcgaggttccggacactccgtttagcaccgagctggcgagctcggataaagagcgcctggaggcagcggccgaccgtgtgctggagcgcctggcggcagcgaaagacccgattatcctgattgatcaggacaccaatcgtcacggtttcgctgacaaatttcgcgcgattatcgacaaggcgcagctgccgtatagccaattgagcagcggtaaggccattctgagcgaacgtgacccgttgtttatcggtacctacaacggcgctgcgtctgcaccgggtgtgcaggagcgcatcgagaacagcgatttcctggtcaccactaacccgcgttttatcgaggtgaacagcggcagctttacccacgatctggacaacgctcatgtgttcaatttcggcgatcaacatctgaatgccgatggcgagtttttcgttggcatcaacacgctggaactgctggatgttctgctggagcgtattccggcaaagaagccgatcggtggtgagaagtttgttcctgaaacgtttgaagtcgaagcggatgcggccctgacgcaggcgcgtatttggcagcagatgttgggcttcattcaggaagatgacgttgtcattgcagaagccggtacctccaatatcggcctgggcccacagcgtatgccggagggtgtccagtatatcaatagcaccatttggggttccatcggtttcaccctgccggcagtcctgggcagccagctggcgaacccggaacgccgccatgttctgttcattggcgatggttctttccaactgactgcgcaagagttgagcaccatcttgcgtcaagagttgaagccgattattgtgctggtgaataacgacggttacaccatcgagcgtttcatcctgggcatggagcaggaatacaacgagattcaaaattggaactacaacgaactgccgaaagttttcaaagcggatacgacgatggagagctatagcgcgaaaacggaaggtgaactgaaggatgctctggaggacatcgcggcacacccggaacgtggtgcgtttctggaagttcacctggacccgtttgatgcacctaagggtttgcaagccttcggtccgctgaccgcagatttcgatttcggtccgcgtggtccacgtaatgcgtaa

SEQ ID NO: 14 - DNA, 1671 bp, Artificial sequence
  Bacillus megaterium QM B1551 sequence codon-optimized for E. coli
atgagctcgaactacaccatcggccactacctgctggaccgcctggcggagctgggtgtgcatcacatgtttggtgtgccgggtgactacaacctgagctttctggatgaggtcatcgatcacaaagaaatcgaatggattggtaactgtaacgagctgaacgctgcatacgccgcagacggctacgcgcgtgtgaatggtatggcagccttgattacgacgtttggcgtgggtgaactgtccgcggtcaacggcatcgctggctcttatgcggagcgcgttccagtggtcaagattaccggtaccccgaccaccaacgttatggacaatggtttgtacgtccatcacaccctgggcaatggtaaattcgatcacttcagcactatgtataaagaggttacggtggcccagacctttctgactcaggagaatgccgcacaagagattgaccgtgttctgctgacgtgctggaccgacaagcgtccggtccatatcaacctgccgaccgatgtatacgataagccgatttccaagccgtacaacagcttgctggacagcgccatcctgagcaacgaagaaaccctgaagcagatgattgttgacgttcctgagcgtatcaatagcgcaaaacgtccggtcatcctggcggactttgaagtcactcgttatcgcgcgcaaaaggcgttgctgcaatttgcggagaaaacgggttttccagttgcgaccttgagcatgggcaagtctgctttcaatgaagcccacccgcagttcatcggcgtttacaatggtgacctgagcagcagctatgttcagaaacgtattgatcagagcgattgcatcatctcggtgggcgtcaaattgactgacagcattacgggtggcttcagccaccaattcagcaaggataacgtcattcacattcacccgtttagcgtccaattcaatagcacgaagtacgcaccggcgacgatgattgactctctgcatgcactgtccagcgccattaccaaacgcaaggcggaggatctggatatcctgagcctgacctcccagatggccgcaaaatcgtacacggcggcagaaaccgaaattacccaagaacgcttcttcgaacgcattgcggcgtttctgcatgagaatgatgttctgctggcggaacagggtacctctttctttggcgcagcgaccatgccgctgcctaaagataccacctttatcggtcaaccgctgtggggcagcattggttatacgctgccggctctgctgggtagccagttggccgacaaaaatcgccgtaacgtgctgctgatcggcgatggtagcttccagctgacggcgcaagagttgagcacgatgctgcgtcagcatatcaagccggtgattttcctgatcaacaatgatggttataccgtggagcgtgcaattcatggtgagaaccaggtgtataatgacatccaaatgtggaactatcaagagctgccggcagtgctgggtccgaaagaccgcagcattaccttcaaggttcgtaccgagatcgaactggaagaggcgctgattctggcggagcagaattaccaacacctggttttcatcgaggtgatgatgcaccgtgacgacaagccggcgttgctggctgaattgtccaaacgttttgcgaaccagaatgtttaa

SEQ ID NO: 15 - DNA, 1647 bp, Artificial sequence
  Helicobacter mustelae 12198 sequence codon-optimized for E. coli
atgaagatctcgatcggccaatacctgctgaaccgcttgaaagactacggcattgagcacatttttggtgtgcctggtgattacaatctgggcttcctggacctgattgaagatgatgaggatctggagtggattggtaattgtaatgagctgaacgccagctacgcagcggacggttatgcgcgtatccgtcctatgggtgctctggtgtctaccttcggcgttggtgaattgtctgcaattaacggtatcgcgggtgcctacgcagaaaatgtcccggtcgtgaaaattgtgggcatgccaagccgcaatatcagcctgaacaaacgcctggttcaccatacgctgggtgacggcgaatttctgaaattctatcgtatgtatgaagaggtcacggttgcccagacgattctgaacaagcaaaatgccaaagaagaaatcgaccgtgtcctgcgcgaatgccacttgcaaaagaaaccggtctatatcggtatcccggttgacgttccgggcctgcaaattgaggcaagcaaaagcgtcgattatcacccgcagagcgacaaaaagatcctggatgcgttcattgcgggtgtgaagaaagagctgctgggcagcaaggcacagatcgttttggcagattacgaggttaaccgttacggtctgaactcggccctgcatgagttcattcaaaagaccaatctgccgatcgcatccctgagcatgggcaagggcgtgttcaaagagagccacccgaactttgtcggtatttacaatggtattttgagcgatgaggcggtcacgagcgcgatcaaacaggctgactgtagcattctgatcggtgttaagctgaccgattccctgaccgcgggttttaactacatcagcaaggacccgccgacgatcgaaattcacccgtttcacagccgtattggtgataagatctatagcgatattctgatgcaagacgtgctgaagaagttgagcgccttgaaatttcatccgcaccgcagcacccataccagcctgccgaagcagaaaccgcatccgtctgataccctgacgcaggagcgcttctttggtttgattgagaaacacctggagccgaacgatgtgctgatcgcggagcagggtaccagcttcttcggcagcgtagacgtgcgtctgccggaaggcgttacctttgtttgccagccactgtggggctccatcggctataccttcggtgcagtcctgggcacgtgcctggcgaacaaggaccgccgtaacatcctgttgatcggtgacggtagcttgcaactgactgcgcaagagctgtccaccatgctgcgtgaaaacattaatccgatcattattgtcatcaataacgacggttacaccgtggagcgttgtattcacggtccgaatcgtaagtataacgatatcaatatgtggcattacacgaaactgattgacacttttgacgttaccctgaagcgcgaggcgctgatctttcgtgcgtcctgcgttaaagaactggaagaagccttcgaaagcgcgcgtgtgcatgctaaacagctggctctgattgaggtggttatggaccgtgatgacgcaccggcgctgctgaaaaagctgggtggcctgttcagcgcgcagaatagctactaa

SEQ ID NO: 16 - DNA, 1665 bp, Artificial sequence
  Clostridium acetobutylicum ATCC 824 sequence codon-optimized for E. coli
atgaaaagcgaatacaccatcggccgctacctgctggacagactgagcgagttgggtattcgtcacattttcggtgtgccgggtgactataatctgagcttcctggattacattatggagtataaaggcatcgactgggtgggtaattgtaacgaactgaacgcaggttacgcagccgacggctacgcgcgtatcaacggtattggtgctatcctgaccacgtttggtgttggtgaactgtccgccattaatgcgattgcaggtgcgtatgcagagcaggtgccggtggttaagattaccggcattccgactgcgaaagtgcgtgataacggtttgtacgtccaccataccctgggcgatggtcgttttgatcacttctttgagatgtttcgcgaggttaccgttgccgaggcactgctgtcggaagaaaatgcggcgcaggagattgatcgtgttctgattagctgctggcgtcagaaacgtccggtcctgattaacctgccgattgatgtgtatgacaaaccaatcaacaaaccgttgaaaccgttgctggattatactatttcttccaataaagaggccgcgtgtgagtttgtcacggagattgtgccgattatcaaccgtgcaaagaaaccggtcatcctggcggactacggcgtctaccgctaccaagtccaacatgttttgaagaacctggctgagaaaaccggtttcccggtagcgactctgtctatgggcaagggtgtattcaacgaggcgcatccacagtttattggtgtgtacaacggtgatgttagcagcccgtatctgcgccaacgtgtggacgaagcggactgcatcatcagcgttggcgtcaagctgaccgacagcacgaccggtggctttagccacggtttcagcaaacgtaatgtgatccacatcgatccgttcagcattaaagctaagggcaagaagtatgcgccgatcacgatgaaagacgcattgaccgagctgaccagcaagatcgaacaccgcaattttgaggatttggatatcaaaccgtacaagagcgacaaccaaaagtatttcgcgaaagaaaagccgattacccagaagcgtttctttgaacgcatcgcacatttcatcaaagaaaaggacgttctgctggcggagcaaggtacctgcttcttcggcgcatctaccattcagctgccgaaagatgcgacgttcattggtcagcctctgtggggcagcattggttacacgctgccagcgctgctgggttcccaactggcagaccagaagcgtcgcaacatcttgctgatcggcgacggtgcctttcagatgaccgcgcaagaaatcagcacgatgctgcgtctgcaaatcaagccgattatcttcctgatcaataatgacggctatacgatcgagcgtgctattcatggtcgtgagcaggtttacaataacattcagatgtggcgctatcacaatgtcccgaaggttctgggcccgaaagaatgtagcctgacgtttaaagttcaatccgaaaccgagctggagaaagccctgctggtggccgacaaggattgcgaacacctgatctttatcgaggtggtcatggatcgctacgacaagccggagccgttggaacgtctgagcaagcgtttcgccaatcagaacaattaa

SEQ ID NO: 17 - DNA, 1641 bp, Artificial sequence
  Macrococcus caseolyticus JCSC5402 sequence codon optimized for E. coli
atgaaacagcgcatcggccagtacttgatcgacgccctgcacgtgaacggcgttgacaagattttcggtgtgccgggtgatttcacgctggcattcctggacgacattattcgtcacgacaatgtcgaatgggtcggtaacactaatgaactgaatgctgcgtacgctgccgatggttacgctcgcgttaacggtctggcggcagtttcgacgaccttcggtgtgggtgagctgagcgccgttaatggcattgcgggcagctacgcggaacgtgttcctgttatcaagatttctggtggtccgagcagcgtggcgcaacaagagggtcgctatgtgcatcacagcctgggtgagggtatcttcgacagctatagcaaaatgtatgctcacatcaccgcaactaccaccatcctgagcgtggacaatgcggttgacgaaattgaccgtgttatccactgcgccctgaaagaaaaacgcccagtccatattcacttgccgattgatgtggccctgaccgagatcgagatcccgcatgctccgaaggtctatacgcacgagagccaaaatgttgatgcgtacatccaagcagtcgagaaaaagctgatgagcgcgaaacagccggtgatcattgcgggccatgagatcaacagcttcaagctgcacgagcagctggaacagttcgtgaatcagaccaatatcccggtcgcgcagctgagcctgggcaagtcggcctttaacgaagaaaatgaacattacttgggcatctacgatggcaagatcgcgaaagagaatgtgcgtgagtacgtcgataatgcagacgttatcttgaacattggcgcgaagctgaccgactccgcgacggccggttttagctacaagtttgacaccaacaatatcatctacattaatcacaatgatttcaaggcggaggacgtgatttccgataatgtatccctgattgatctggtgaacggtctgaacagcattgactatcgtaacgaaacccactatccgagctatcagcgttctgatatgaaatatgagctgaatgacgcgccgttgacccaaagcaattacttcaaaatgatgaacgcgtttctggagaaagatgatatcctgttggccgagcagggtacgagcttctttggcgcatacgatttgagcctgtacaagggcaaccagtttattggccaaccgctgtggggctctattggttacaccttcccgagcctgctgggcagccaactggcagacatgcatcgtcgcaacattctgctgatcggtgatggttccctgcaactgacggtccaggccctgtctaccatgattcgtaaggacattaaacctatcattttcgtgattaacaacgacggttatacggttgagcgtttgattcatggcatggaagagccgtataacgatatccaaatgtggaactataagcagctgccggaagtttttggtggtaaggacaccgtcaaagttcatgatgcgaaaaccagcaacgaactgaaaacggtcatggatagcgtcaaggcagataaagaccacatgcactttattgaagtgcacatggcggttgaggacgcaccgaagaagctgatcgatatcgcaaaagcgtttagcgacgcaaacaaataa

SEQ ID NO: 18 - DNA, 1677 bp, Artificial sequence
  Nostoc punctiforme PCC 73102 sequence codon-optimized for E. coli
atggccacgttcactgtcggcgactatctgctgctgcgcttggaacaaatcggtatcaagcacattttcggtgttgcgggtgattacaatatggagttcctggattacattgtcaaccataacggcattgagttgattccaacctgcaatgagctgaacgcctcgtatgcagcggacggttacggtcgtctgaatggtattgccgcgctgatcaccacctttggcgttggtgaactgagcgccattaacggtgttgcaggtgcgtacgcggaacacgttccggtcgttgcaattaccggcgcaccggcgacgaaaatccaggcgctgggtagcctggtgcaccacacgctgggcacgggcgatttttctatgtttgcgcgtatgtacgaacaagtcaccgtagcccaagcgtatctgaccaatgaaaacgcgacgaccgagattgacggtgtcctgggcatttgtttgctgaaaaagctgccggtttacatctccatcccgatggatgtggcgctgaccgaggttagcgcaccgagcgatagctttattccaccggttttccagagcgatggcgctaccctggcagagatcgttgacgtctgcgtgaacattctggagaaggccagccagccggttattctggcggatatcggtgttgcccgttatcacctgcatgaacagttgcgtaagttgctgaccgcgaccggttatccgtatgctaccatgaatatgggcaaaggtctgctggaagaaacccatccgcagtttattggtatttacaatggtgcagcaagcgaagaaagcgtccgcaagcgtattgagcaggcggattgtgtgctgaccatcggcgctctgatgaccgacttcaacaccggcaaattctccgcgaaactggacccgagccagacgattgaagtgcacggtcagtacgttaaggtgaagcacgcgctgtataacaatgtggcgatggccgatgtcctgtccgcgctgagccagcgtctgcaacgccgtgacccgcaaacgctgaatttcaagagcgcgacggaaaacttggatgctggctttatcaccccgatcgagggcggttctagcgcgcctatcacccaacagtatttctggcatcgctttgcccatttcttgcaagaggatgacatcatcgtcgcagaaaccggcacttgtctgtttggtgcttctatcgtgccgctgcctaaaggtgcgaccttcgtgggccaggtcttgtggggtgcaatcggttacagcgtggcttccctgctgggttgcgccttggcaaagccgacggcaggtattgcagcgagccaacgccgcagcattctgctggtgggcgatggcagctttcagatgactgcacaggagctgagcacgatcctgcgttacaacttgaaaccgatcatcttcctgattaacaatgatggttatacgattgagcgtgacatccacggtgagcgtatgccgtacaacgacatccagccgtggaactaccatcagctgccgaaggtgtttggcggtaatggctggggtatcaaagtctcgaccgagagccaactggacaaagccctgcaaacggctcaacagaatcacgaccaactggcgttcattgaggttgtgatggacaaaatggacagcccagaggtcctgctgaaaatgctgcaacagtaa

SEQ ID NO: 19 - DNA, 1659 bp, Artificial sequence
  Sarcina ventriculi sequence codon optimized for E. coli
atgaaaatcaccatcgctgagtacctgctgaaacgcctgaaagaagtcaatgtggaacacatgttcggtgttccaggtgactataacctgggttttctggattatgttgaagatagcaaggatattgagtgggtcggtagctgcaatgaactgaacgcgggctacgcggctgacggctacgcccgtctgcgcggtttcggtgttatcctgaccacctatggtgtgggtagcctgagcgcaatcaacgcgactaccggcagcttcgcagaaaatgtgccagtcctgcacatcagcggtgtgccgagcgcattggtccagcaaaaccgtaaactggttcaccactctacggctcgtggcgagtttgatacctttgagcgtatgtttcgtgaaatcaccgagttccaatctattatctccgaatacaatgccgcggaagagattgaccgcgttattgagagcatttacaaatatcaactgccgggttacattgagctgccggtggatatcgtgagcaaagagatcgaaattgacgaaatgaaaccgctgaacctgaccatgcgtagcaacgagaaaaccctggaaaagttcgttaacgacgttaaagagatggttgcatccagcaaaggccagcatatcttggcggactacgaggtgctgcgcgcgaaggccgagaaagaattggagggtttcattaatgaggcaaagatcccggtcaacacgctgagcatcggcaagaccgccgtttccgagtccaacccgtattttgcgggcttgttcagcggtgagactagcagcgatctggtgaaagagttgtgtaaagcgtcggacattgttctgctgtttggtgtgaagttcattgacaccaccacggcgggtttccgctacatcaataaagacgtaaagatgatcgagattggcttgacggattgccgtattggcgaaaccatctataccggcctgtacatcaaggacgtgattaaggcgctgacggatgcgaaaatcaagtttcacaatgacgtcaaagttgagcgtgaagccgtggagaagtttgtgccgacggatgcaaagctgacgcaggatcgttatttcaagcagatggaagcgttcctgaaaccgaatgacgtgctggtcggtgaaaccggtacgagctactctggtgcgtgtaatatgcgttttcctgagggtagcagcttcgttggccaaggtagctggatgtctatcggctatgcaacgccggcagtcctgggcacccatctggctgacaaatcgcgtcgcaacattctgctgtccggtgacggcagctttcaactgaccgtccaagaggttagcaccatgatccgtcagaagctgaacaccgtgttgttcgttgtcaataatgatggttacacgatcgaacgtctgattcatggtccggaacgcgaatacaaccacattcagatgtggcagtatgctgaactggtcaagacgttggcgacggaacgcgatattcagccgacctgctttaaggttaccactgagaaagagctggcggcagcgatggaagagattaacaagggcaccgagggtattgccttcgtcgaggttgtgatggacaagatggatgccccgaagagcctgcgtcaagaagcgagcctgtttagcagccagaacaattactaa

SEQ ID NO: 20 - DNA, 1686 bp, Artificial sequence
  Bacillus thuringiensis serovar tochigiensis BGSC 4Y1 sequence codon optimized for E. coli
atgatccatctgaaaacccaatacaccgtgagcacctatctgctggaccgtctgagcgaactgggtatcgagcacatcttcggtgtgccgggtgactataatctggcgttcctggatgatgtgattgcccacgagaacgtggaatggatcggcaactgcaatgagctgaacgctgcttatgccgcggacggctatgcacgtatcaagggcattgcagcgctgattaccacgttcggcgttggtgagctgtcggctattaacggtattgccggcagctacgcagaaaatgtgccggtcattaagattaccggtactccgccgaccacggtgatggaaaatggtgcgctggttcaccacacgctgggcgacggcaagtttgatcactttagcaacatgtaccgcgagatcaccgtcgcccaaagcaagctgacgccggaacatgcggcagaagagatcgatcgtgtactgcgcgcgtgctggagcgccaagcgtccggttcacatccaactgccgattgatgtatacaataaacctattaacaaaccgaccgaaccaatcttgcataagccggttgtctccaacaaagatgcactggacaagatgttgctgcacgcgaccagcaagatcaattctgccaagaaaccggtcattctggcggactttgaggtcgaacgttttcatgcgaaagagtacctgtatcagttcgttgagaaaacgggttttccgattgcgacgctgagcatgggtaagggtatcttcccggaaaagcactcgcagttcatcggtgtgtacacgggtgacgtgtccagcccgtacctgcgcaaacgtatcgacgaaagcgattgtatcattagcattggcgttaagttgaccgacacgatcacgggtggttttacccaaggctttaccaaagaacaggttatcgagattcatccgtataccgtgaagatcatcgataagaaatatggcccggttgttatgaaagatgtcctgcaacaactgagcgatttgattgagcaccgcaacaagaacgacctggagatcaaaccgtttctgtctgagagcagcagcttcaccgaagagtttaacccgaaagcgcagatggttacgcagaagcgtttctggcagcagatttaccatttcctgcaagagaatgacgttctgattgcagagcagggtaccccattcttcggcagcaccgcgatcccgctgccgaacaacacgacctatgtcgcacaaccgctgtggggcagcattggttataccctgccagctctgctgggtactcaattggcgaacttgtctcgtcgcaacatcctgatcattggtgacggtagctttcagctgacggtccaggaactgagcaccattctgcgtcagaatttgaatccgattatcttcctgattaacaataatggttacaccgtggaacgcgcaatccacggccagaatgaaccttacaatgacatccagatgtgggactacacgaaactggcgaacgtgttcggctccaaagagaagtccctgacttgtaaagtcgagaatgagattgagctggaagaggttctgaccaaaatcagcattgataagaatcaactggcatttgtggaagttgtcatgagccaaggcgatcagccggagctgttggcgaaattgggtaaacgtttcggtcaacagaactcctaa

SEQ ID NO: 21 - DNA, 1686 bp, Artificial sequence
  Bacillus cereus Rock3-29 sequence codon optimized for E. coli
atgatcctgctgaaaacccaatacaccgtgagcacctatctgctggaccgtttgtacgaactgggcatcgagcacatttttggcgtgccgggtgactataatctggcgtttctggatgatgtcatcgcacacaaaaatctggagtggatcggtaactgcaacgagctgaatgcggcgtatgcggcggatggctacgcccgcattaagggtgttgcggcgctgatcaccaccttcggcgtgggtgaactgagcgcgatcaacggtatcgcaggtagctacgcagaaaatgtgcctgtcattaagattaccggtacgccgactaccaccgtgatggagaacggtgagttggtacaccacacgctgggcgacggcaaattcgatcactttagcaacatgtatcgcgagatcacgattgcgcagactaccctgattccggagcatgccgccgaagagattgatcgcgtcctgcgtgcgtgctggaatgagaaacgtccggtacatatcaatctgcctattgacgtttacaataaaccgatcaataagccgaccgaaccgattctgaatcacccaatcgtttccaacaaagatgctctggacaaaatgctgctgcatgctatctctaaaatcaatagcgcaaagaagccggtgatcctggcggactttgaagtgaaccgcttttacgcagaagaggacctgcatcagttggttgaaaagaccggttttccgattgctagcctgagcatgggcaagggtatctttccggaaaagcacccgcaattcattggcatctataccggtgacgtcagcccgccatatctgcgcaagcgtgttgacgagagcgactgtatcattagcattggtgtcaagctgaccgatacgatcaccggtggttttacccaaggcttcacgaaagaacaggtcatcgagattcatccgtacacggtgaagatcatcgacaagaaatatggtccagttgttatgaaggatgtcttgcaatatctgagcaactccattaaacatcgtaatgaagagacttttgagattaaaccgttcatttctgaatccagcagcatcaccaaagagttcaatccgaaggcccagattgtcacgcagcagcgtttctggcaacagctgtaccactttctgcaagagaatgacgttctgatcgcggaacagggcacgccgtacttcggttcggcagccatcccgctgccgaataatgcgtccttcgttggtcagccgttgtggggtagcattggctatacgctgccggccttgttgggtactcagctggctaacgtgacccgccgtaacattttgattattggcgatggtagcttccaactgaccgtgcaagaactgagcacgatgctgcgtcacaacctgaaacctattatcttcttgattaacaacaacggctacacggttgaacgcgcaatccacggtcgtgatcaaccgtacaacgacatccagatgtgggactacaacaagctgccgaacgtttttggcagcgaagagaagagcctgaccttcaaagtggagaacgaaatcgagttggcggaggttctgaataagatttctttcaatatgaatcgtctgattttcattgaggtggtcatgagccagggtgatcagccggagctgctggcaaaactgcgtaaacgttttggcattcaaaacagctaa

SEQ ID NO: 22 - DNA, 1644 bp, Artificial sequence
  Lactococcus lactis sequence codon optimized for E. coli
atgtataccgtcggggattacttgttagatagacttcacgaactaggtatagaggagatctttggcgttcctggtgactacaatctacagttccttgatcaaatcatatcaagagaagatatgaaatggattggtaatgctaatgaattgaatgcttcatacatggctgatggttacgctagaaccaaaaaggctgccgcatttctaactacatttggtgttggggaactttccgcaatcaatggtttagctggctcatacgccgaaaatcttccagttgttgaaattgtcggctccccaacatcaaaagtgcaaaatgatggcaaattcgtgcatcatacactagcagatggagacttcaaacacttcatgaaaatgcatgaacctgttactgctgctcgtacacttttgacagcagaaaatgcaacctacgaaattgacagagtgctgtctcagttgctaaaggaaaggaagcctgtctacatcaatcttcctgtggatgttgctgccgctaaagcagaaaaaccagccttatctttagagaaagagagttccaccacaaatacaactgaacaagtgattctatcaaagatagaagagtccttgaaaaacgcacaaaagcctgtagttattgcaggtcatgaggtcatatcttttggattggagaaaaccgtaactcaatttgtttcagaaactaaactgccaatcacaactttgaatttcggtaagtcagctgtcgatgagtccttgcctagtttccttgggatatacaatggaaagttgagtgaaatcagtttgaaaaactttgtcgaaagtgccgactttatcttgatgttaggagttaaactaacagactctagtactggagcttttacccaccacttagatgaaaacaaaatgatttccttgaatatcgatgaaggtatcatattcaacaaggtagtagaggactttgattttcgtgccgtagtctcttccttatcagaacttaaaggtattgaatacgagggccagtatatcgacaagcaatatgaggagttcatcccttcatctgccccattgtctcaagacagattgtggcaagctgttgaatcattaacacaatcaaacgaaacaattgtagcagaacaaggtacttcctttttcggagcctctactatctttctgaagtcaaattctagattcatcgggcagccattatgggggtctattggttacactttcccagctgctttaggctctcaaattgctgacaaggagtcaagacatctactgttcattggcgacggatctttacaattgacagtacaggaattgggactttctataagagaaaaactgaatccaatttgctttatcatcaacaacgatggttacacagtggaaagagaaatacatggcccaactcaatcttacaacgatattccaatgtggaactattctaagttgccagaaacttttggtgcaactgaggatagggtagtgtctaagatcgttagaacagaaaatgaatttgtgtctgttatgaaggaagcccaagcagatgttaacagaatgtattggattgaattagttttagaaaaggaggatgccccaaaactactgaaaaagatgggtaaactgttcgccgaacaaaacaaatga

SEQ ID NO: 23 - DNA, 1644 bp, Artificial sequence
  Lactococcus lactis sequence codon-optimized for E. coli
atgtataccgtcggggattacttgttagatagacttcacgaactaggtatagaggagatctttggcgttcctggtgactacaatctacagttccttgatcaaatcatatcaagagaagatatgaaatggattggtaatgctaatgaattgaatgcttcatacatggctgatggttacgctagaaccaaaaaggctgccgcatttctaactacatttggtgttggggaactttccgcaatcaatggtttagctggctcatacgccgaaaatcttccagttgttgaaattgtcggctccccaacatcaaaagtgcaaaatgatggcaaattcgtgcatcatacactagcagatggagacttcaaacacttcatgaaaatgcatgaacctgttactgctgctcgtacacttttgacagcagaaaatgcaacctacgaaattgacagagtgctgtctcagttgctaaaggaaaggaagcctgtctacatcaatcttcctgtggatgttgctgccgctaaagcagaaaaaccagccttatctttagagaaagagagttccaccacaaatacaactgaacaagtgattctatcaaagatagaagagtccttgaaaaacgcacaaaagcctgtagttattgcaggtcatgaggtcatatcttttggattggagaaaaccgtaactcaatttgtttcagaaactaaactgccaatcacaactttgaatttcggtaagtcagctgtcgatgagtccttgcctagtttccttgggatatacaatggaaagttgagtgaaatcagtttgaaaaactttgtcgaaagtgccgactttatcttgatgttaggagttaaactaacagactctagtactggagcttttacccaccacttagatgaaaacaaaatgatttccttgaatatcgatgaaggtatcatattcaacaaggtagtagaggactttgattttcgtgccgtagtctcttccttatcagaacttaaaggtattgaatacgagggccagtatatcgacaagcaatatgaggagttcatcccttcatctgccccattgtctcaagacagattgtggcaagctgttgaatcattaacacaatcaaacgaaacaattgtagcagaacaaggtacttcctggttcggagcctctactatctttctgaagtcaaattctagattcatcgggcagccattatgggggtctattggttacactttcccagctgctttaggctctcaaattgctgacaaggagtcaagacatctactgttcattggcgacggatctttacaattgacagtacaggaattgggactttctataagagaaaaactgaatccaatttgctttatcatcaacaacgatggttacacagtggaaagagaaatacatggcccaactcaatcttacaacgatattccaatgtggaactattctaagttgccagaaacttttggtgcaactgaggatagggtagtgtctaagatcgttagaacagaaaatgaatttgtgtctgttatgaaggaagcccaagcagatgttaacagaatgtattggattgaattagttttagaaaaggaggatgccccaaaactactgaaaaagatgggtaaactgttcgccgaacaaaacaaatga

SEQ ID NO: 24 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 25 - DNA, 1653 bp, Erwinia amylovora
atgagtacttataccgttggcgattatctgcttacacgtttaaacgagatcggtattagccatctgtttggtgtgccgggtgattacaatttgcgctttctcgaccatgttatcgatcatcccgatgtagactgggtcggctgcgccaatgaactgaacgccgcctacgccgccgatggttatgcccgttgccggggggcaggcgcgctgctgaccacttttggcgtgggtgaactcagcgcgataaacggtgtggccggcagcagtgcggagtatctgccggtgatccacattgtcggcgcgccgtcacaaacttcacaaaacaagggagagcttttgcatcacacccttggtgacggtgactttggtcattttattcgtatgcaacaggagatttctgtcgccagcagcgtgctgaccaccgccaatgccgccgctgaaatcgatcgggtgttgttcgaagcgctgacaaagcggcgcccggtctatctgctgctggcaacaaatgtggcagaaagcccgctctctcctccttcttccccgcttgagctgcggctggattgcgataaggctcaactggcggcctttgtcgatgcggccgaatccctgctggcgccagcgagcagcgtggcgatgctggccgattttcttgccgatcgtgctcagcagcagcagagattgcagcgctggctggaggagataccgatgccctttgccacgttactgatgggcaaaagcgtgctgccggaaatgcttacaggttttgtcggaacctatgccggggcagccagcgctgacagcacgcgcgcggtgattgaaaacagtgatgtgttaattagtgtgggcgtcaggtacaccgatagcattaccgccggttttacccagcagataacgtgcagtaaaaatattgacgttggcctgcattccagcagcgtggcgggccagccatttgagccggtaccgatggcggcggcgcttgaggcactgtatcagctggcgcggaaatatggtcagggctggcagcgcggcattgttgctcccccggttagcgaagagcagtcgtcagacggcctgacgcaagatactttctggcatgcgctacaggactttctgcgccctggcgatattgtgctggccgaccagggcacggcagcatttggcgcggccgctctgcgcctgccacaggatgttcgcctgctggtgcagccgttgtggggatcgataggttataccttaccggcggcgtttggtgcgcaaacggcacgaccacagcagcgggtggtgctgattattggcgatggatccgcccagctgacggtgcaggagttagggagcatactgcgggacggtcaaaagccggtgattttcctgttgaataatgacggctacaccgtagagcgggcgatacacggggcgcagcagcgctacaacgatattgcccgctgggactggacccgtctgccgcaaacgctgggtattgacagcctggctcagagctggcgcgtgacgcaaacggttcagctacgcgaagtgatgaagctgctgcaagagggggggcatctctcgctggtggaggtggtgctgccaaggcttgatgtgccgcccctgttggcgtccgtgtgtcatgccctcaaccagcggaacaacagttaa

SEQ ID NO: 26 - DNA, 1629 bp, Thauera sp.
atgaacctgaccgaatcgctgctgcacgcgctggtcgaccacggcgcacgccagatcttcggcatcccgggcgacttcgccttgccgtatttccgcatcatcgagcagaccggcatcctgccgctgcacacgctgtcgcacgagcccggcgtgggcttcgccgccgacgcggccgcgcgcgtccagggtggcatcggggtggcggcggtcacctacggcgccggcgcgctcaacatggtcaacgcggtcgccgccgcgtatgccgagaagtcgccgctggtggtcatctcgggcggaccggggctgggcgaatcgcaatccggcctgctgctgcaccaccaggccaagacgctggactcgcagttgcgcatcttccaggagatcacctgcgaccaggtgcggctcgacgacgcggcacgcgcgccggccgacatcgcgcgcgtgctcggcaactgcgtgcgcaattcactgccggtgtacatcgagatcccgcgcgacatggtcgcccggccatgcgcgccggtagtgcgcgaggcgccgcgcgcggtcgatgccgacgcgctcgcggcctgtgtggacgagatcctcgcacgcctgcgcgcggcccgtgccccggtgctgatggccggcgtcgaggtgcgccgcttcgggctggaggacaaggtcgcagagctgtcgcgccggctcggcatcccggtggtgaccagcttcatgggccgcggcctgctcgccgaccaggacgccccgctgatgggcacctacatggggctcgccggcctgcccgaggtgagcgcgctggtggaggattccgacggactgttcctggtcggggtgatcatctccgacaccaacttcgccgtctccggcaagcacatcgacctgcgccacaccatccaggcgctcgaggcccgggtcacgatgggctaccacacctatgccgacatcccgctcgacgccctgatcgacgggcttctcgcgcgcgttccgcacgccgacgcgcacttcacggtcgaccgccccgcctttccgcacggcctgcaggcggacgaagcgacgatcgcgcccgccgacatcgcctgcgcggtaaacgacctgatggcggcccacggcaagctgccgatcgcctccgacatgggcgactgcctgttcaccgcgatggacatcgagcacaccgcgctggtcgcgcccggctactacgccaccatgggcttcggcgtgcccgccggtctcggtgtgcaggccgccaccgggcagcggccgctgatcctggtcggcgacggcgccttccagatgaccggctgggagctcggcaactgccggcgctacggctgggatccgatcgtgctgttgttcaataacgcgagctgggagatgctgcgcaccttccagcccgagtcaggcttcaacgacctcgacgactggggcttcgcgcagatggccgcgggcctgggtggcgacggcgtgcgcgtgcacacgcgcgcgcagctgaaggctgcgctcgacaaggcgatcgccacgcgcggacgcttccagctcatcgaggtgatgatcccgcgcggcgtgctgtcggagtcgctgtcgcgcttcgtcaacgcggtcaagcgcctcaacgccgccaaggccgcctga

SEQ ID NO: 27 - DNA, 1653 bp, Frankia sp.
atggtcacgaccgtgatccagcacgtgctgaaccggctgcgggatctcgggatccgccacgtgttcggggtccccggtgactacgccttccccgtcgacgacgccgtgatcgcgcatccggacatccagtggatgggcaactgcaacgagctgaacgccgcgtactgcgcggacggctacgccagggtccacggaatgggagcggtgagcaccacctacggcgtcggcgagctgagcgccatcaacggcatcgccggcgcctacaccgagcatctcccggtcttccatctggtgggcatgccgaagatgccggtacaggcccgccacgcgctcgtgcaccacaccctcggaaacggcgagttcgacctcttccagcggatgtccgacccggtggtctgcgccagcgcgatcatgaccccgcagaacgtggccgccgagacggaacgcctgatcgccgcggcgatctaccaccgccgcccggtctacctggcgttccccgccgacctggccgagctgccggtggcgagcgaggcgcccgagctgcccgccccggccagcgacccggctcagctcgacgccgcggtcgcggcggtggcggaccggctgcgccacgcgggcagcgcctgcctgctgcccggcgccctcgccgtccgcgcgggcctgggccggcacctgcagcggctggtcgacgcctccggcctgcccttcgccaccatggtcgccgacaagggggtgctggacgaggaccagcccgggttcgtcggcatgtacgacggcaagctgatgaacgaggacgtccggcgcctggtcgaggacggtgacgtcgtggtcctggtcggcgcgctgatgcacgacttcaactccggcgcgttcacggccaacctcgacccggcgagaaccgtcgacatccgccaccatcacgtccaggtcggcgccatgacctacccgagcgtcgagatgagggacctgctgaccgcgctcgcggcccggctgccgacgcggacctggccgcgaccgtccgccggcgtggtccggatgcgctccgaaccgggcagcggcgacgaccccctcaccgccggcactctgtacccgcgctgggagaggttcctgcgaccgcgcgacatcgtcgtcgcggagaccgggacctgctcgatgggcatggccttcgcccggcttccctacggggcgacgttcgagaaccagacgctgtgggggtcgatcggctgggccacccccgcggccgtcggagccgccgtcgccgccggcccggaccgccgcgtcgtgctgatcaccggcgagggctcgcaccagctgacggcccaggagatcagccagttcggccggtaccggctcaggccggtggtgttcgtgctgaacaactccggctatctgatcgaacggctgctgtgcaagcacccggacctcgcgtacaacgacctggcccggtggcactacgccgaactgcccagggtgctcggctgcgaggactggttcaccgcccgcgtctcgacctgcgccgagctcgaccgggcgctggacacggcccggcacgccagcaccggctgctacatcgaggtgctgaccgacagccacgcggcgccaccgctggcgacccggatgcacgagaacctcggcagcctctacgccggctga

SEQ ID NO: 28 - DNA, 1722 bp, Acinetobacter sp.
atgttcatagaaattggtgaatttttaaatcttcgtctaaaacaaatgggtatccaacatctttttggtgtacctggtgattttaacctctcatatctagaacaagttgaagcagacccacaactcgaatttattggaaattgtaatgaattaaatgctgcctatgcagcagacggttatgcgcgaattaacggtttttctgccttggctacgacttatggtgtaggtgacttaagtgccattaatggtattgctggtgcctatgcagaaaatgtacctcttattcatatctcaggtattccacctttacatgcagtacaaaagggcactttaattcaccacacgcttgttgatggtaactatgacaatattatgaactgtatgaaagagttcacagttgcccaaactcgtttaactcctgcaaatgcagcttctgaaattgatcgtgtgttacgtcagtgtttccttgaacgccgtcctgtacacatccaactacctggtgatattactcacgttaaaattgaagtgtctgagcgtccgctcgacctaagttatccagctgttgagcctgaattattgcaaagtgtggtgagcaaactttgtgacattattgagaatgctcaaagtccagcgcttttaattgataatgaagcttcagtttttggtgtaacttcacttttaaatgatttgtctcaaaaatgctcaattccatttgcaggtatgaatactgcaaaaaatattatggatgaaggttcaccacgctacattggtacttatgttggtggggcgagccaaccgcatgtgaaaaatatcattgaacaatctgactgtttaattggtattggcgcgcgctttaccgatgtaggctcagctgtatttactcatcaaattgagaccaggaactacatcgaaattaaatcttatggcttaaatatttttggtcaggattttccgggtattgaaattggacaattacttgttgagctaaataaaaaagttgcgccacgtaaatcgtcagttccccttcttgaaaaacaacctcagaaagtagttgaagcgccagctcaacagagactaagccaagatgtgctttggaactacatttcaggtttcttaaaagaagatgatgtgattattggggaagtcgggacatcaaactctgctttgtcaggtataaaactgcctgctacagctaaatatattgcacagccactttggggttctattggttacaccttacctgctttgcttggtagtttgttagctgcccctgaacgccgtcaaattttgtttattggtgacggttcgttccagcttacggtacaagagctttctacaattatccgtcatggtttaaaaccaattattttcttgctgaacaatggcggctataccattgagcgcttaattatgggtgaaaacgctgcctataacgacgtgcaaaactggaaatacactgaaattccagcggtatttaacggtaagaaaggccatacaacttatgtggttgaaactgcaggacagttaaagagtgttttagacaacgttcagcaaaatgaccagttaacttttattgaattaaaactaccagcaatggatgccccggtgagtttgaaaaaatttgcttctgtgattgcacgttttgattacggcgatcgtggctacgaaattttaaaggagcgttcccaacctattaaatgtaaggatgcaagctcgttttaa

SEQ ID NO: 29 - DNA, 1626 bp, Anabaena variabilis
atgcctcaactagcaccgcatatatttgatattttataccaaaaaggtgtagaacacgcatttggtatacctggggattttgccttaacactattcgatgcactagcagacagcaagattgcacctattgtcatgacgcacgaaccctgcgtaggctttgcggctgatgcttactcccgaatgcggggtttgggtttagcggttgttacctatagcgttggcggcttaaatatggtgaatgctgtagctggtgcttatgccgagaagtctccgttggtcattttaagcggcgggccaggtgtgcgagaacaaaaggagcatgacttgttacatcataaggtgaaaacttttgacacacaacggcgtgtttatgaagaagtcaccctttacgctacaaagctaaccgatccaaaaacagccgatgctaaaattcatcatgctcttgactatgcaacgacattcaagcgtcctgtttatttggaaattccccgtgatctagtttatgcggagattacagagtcagaacacttgccaccaccaatcaagcgcactgatccagatactttaacggaagccattgcagaaactctggagatgctcaagcgatcgcactcaccagtcattcttgcttgtgttgaagttcatcgctttggcttgcaggaacaacttctagctttggcagaaaaacttggtgtaccagtctgctcaacaatgttaggaaaatctgtttttcccgaaagacatccgcaatacatcggtatctacaatggtgaggctggggatttaaatgtgcagaaaatcgttgaagaatcagactgtgtgctgatgttgggagtgtttatgactgatatcaacctggggatgtttaccgctcatctcaacccaggttttacagtgtatgcaacttcagaacgcctcgccattaagcatcacgaataccccaatgtgaggtttgaagattacatcaccaccttgcttgatagtccagatttgcctcattgggattcatccggcatctatactatgaaaccgcgtgttacgccatctgtgggtaaaatttccatgagtggactactttatgaactcaatcagttcattgacagtaacactctactagtgacggatgttggagatgccctatttgcagcagatgatatccagacacagcaaggcacatcattcttatgtcccgccttctacgccagtatggggtttggcgttcctggggtgattggcgcacaattagccgacccatcccgacgagcgatcgctttggttggcgatggggcgtttcacatgacaggaatggaattgctcacagcgcaacgcttaagactaaacccgattgtcatagtcattaacaatggctcatttgctagcctccaggcaatgggacatcaagaagcggcttttgtccaaatacccacaatggactatgcccagttagctaacgttcttggtggtcatggctttgtgatccacactagtacacagctacaacaagccttacagacagcgcaaaatagtaagactttcagtattcttgatgttcatctctcacctgacgatgtttcgcctgccttacaaagattgagcgcactatttaccaaatccctcaaaggataa

SEQ ID NO: 30 - DNA, 1725 bp, Mycobacterium kansasii
atggtttcggccgggcgtaccgtcgtcttcgtgaccgatcgcgcggctggccccaacgaacccgtgtacaccgtcggcgactacctgctggaccgactcgccgaactcggcgtttccgaaatcttcggcgtgcccggggactacaacctggagttcctcgaccatatcgtggcccatccggccatccggtgggtgggcaacgccaacgagctcaacgccggctatgccgccgacggctacgggcggttgcgcggaatgtcggctgtggtaacgacattcggtgtcggtgaactgtcggccgccaatgcgatcgcgggcagctacgccgagcatgtgccggtggtccacatcgtcggcggtccctccaaagacgcccagggcacccggcgggccctgcaccattcgctcggcgacggcgacttcgagcacttctttcggatcagccgcgaaatcacctgcgcccaagccaatctcatgccggcaacggcatgccgggagatcgaccgggtgctgtgtgaggtgcgggagcagaagcggcccggatacctgctgctgtccaccgacgtggcccgcttccccaccgagccgcccggcgctccgctacccccttacggcggcggcaccagtccgcgcgcgctgtcactgttcaccgaggccgccgccgcactgatcggcgagcaccagctgaccgtgctggccgacctgctggtccatcggttgcgggcggtcgacgagctggaggcgttgctggccgccgacgtggtgccgcatgccacgctgatgtggggcaagagtttgctcgacgagagctcgcccaacttcctgggcatctatgccggagccgccagcgccgcgcgagtgcgcgcggcgatcgagcaggcgcccgtgctggtgacggccggggtggtgttcaccgacatggtcagcggattcttcagccagcggatcgacccggcgcgcaccatcgatatcggccagtaccaaagcaccgtggccggccgggtgttcgcgccgctcgagatgagcgccgccctgcgcgcgatcgccgagatcctgaccgggcgcgggataacctcaccccccgtgccggctccggatgaccaccgtccggcatcgactccgcagcgcgatgaccctctgacccagcggatgttgtgggaccgggtcaacgacgcgcttacccccggcaatgtggtgctggccgagcagggcacctcgttctacggcatggccgaccaccggttgccgcacggggtcaccttcatcggtcaacctctttggggctcaatcggttacacgttgccggcggcgctgggggccgcggtggcgcatcgtgaccgcaggacggtactgctgatcggcgacggggccgcgcaactgaccgtccaggaaatcggcaacttctcccgcgagggcctgtcccccgtcatcgtggtggtcaacaacgacggctacaccatcgaacgggcgatccacggcgaaactgcctcctacaacgacatcgccgcctggagctggaccgccgtccccagcgcgctgggagtgaccgaccacctggcatttcgggcgcggacctacggcgaactcgacgatgcactcaccgcggccgcggcgcaccgggaccgtttggtgctcgtcgaagcggtgctgccacgactcgaaatcccgcatctgctcagcgatctcgtcgcgcccacgtcgtcggacggcaccgcgcgccgctga

SEQ ID NO: 31 - DNA, 1647 bp, Listeria grayi
atgtatacagtaggtcaatatttggtcgaccgtttagaagaaattggcattgacaaagtatttggtgtgcccggcgactataatttaactttcttagactatatccaaaaccacgaagggcttagctggcaagggaataccaacgaattaaatgccgcttatgctgcagatggttatgcccgcgaacgtggtgtgagtgctttagttaccacatttggtgttggtgaattaagtgcgatcaatggcacagcgggaagctttgccgaacaagttcctgtcatccatatcgtcggatctccaactatgaatgtgcaatccaataaaaaattagtacatcactcgctaggaatgggaaacttccataatttttccgaaatggcaaaggaagtcactgctgcaacaacgatgctgacagaggaaaacgccgcgtcagagatcgaccgtgtgcttgaaacggcattgcttgaaaagcgtcctgtttatatcaatctgccaatcgacatcgctcataaggcgattgtaaaacctgctaaagccttgcaaacagaaaaatcaagcggcgaacgtgaagctcaattagcagaaatcattctatctcatttggaaaaagcggcgcaaccgatcgttattgccggtcacgagatcgctcgtttccaaattcgtgaacgttttgaaaactggatcaatcaaacaaaattacccgtaactaatcttgcttatggtaaaggttcttttaatgaagaaaatgagcactttatcggtacgtattaccccgcattcagcgataaaaatgttttagattatgtggataacagcgattttgtcttgcattttggcgggaagatcatcgacaactcgacttcttcattcagccaaggttttaaaacagaaaacacactgactgctgcaaacgacattatcatgctaccggatggcagtacgtatagtgggatttctttaaatggattgctagcagaattagaaaaactgaactttacttttgctgatactgccgcaaaacaagctgaactagctgtttttgaaccgcaagcagaaacaccactgaaacaagatcgtttccatcaagctgtgatgaacttcttacaagcagatgatgttttagttactgaacaaggaacttcttcgttcggtctgatgctggcgccacttaaaaaagggatgaatttgatttcgcaaacactatggggatcgattggctacacgcttccggcaatgatcggcagccagatcgccgcacctgagcgccgccatattttaagtatcggcgacggatctttccaattgacagcgcaagaaatgagcacgatcttccgcgaaaaattaacaccggtcattttcattatcaacaatgatggctatacggtagaacgcgcgatccacggcgaagatgaaagctataatgatattccaacttggaatctgcaattggtagctgaaacgtttggtggcgatgcggaaacagtcgacacacataatgtgttcacagaaactgattttgccaacacacttgcagccatcgatgctactccgcaaaaagcacatgttgttgaagtacacatggagcaaatggatatgccggaatcattacgtcagatcggacttgcgttgagcaaacaaaatagctga

SEQ ID NO: 32 - DNA, 1686 bp, Bacillus thuringiensis
atgattcatttgaaaaaacaatatactgtaagtacatatttattggatagactacacgaattaggaattgaacatatatttggggttcctggtgattataatcttgcctttttagatgatgtagtagcacatgaaaatttaaagtggattggcaattgtaatgaattaaatgctgcatatgcagcagatgggtacgctcgcataaaaggaatcgctgctctaattactactttcggtgtcggagaattaagcgccattaacggcattgctggctcatatgcagaaaacgtaccagttataaaaatcacgggtacgccaccaacaaaagtaatggaaaatggagcaatcgtccatcatacgttaggcgatggaaagttcgatcacttttccaatatgtatcgagaaatcactgtggcacaaacaaatgtaacacctgagcatgctgctgaggaaatcgaccgtgtattacgtgcatgttggaatgaaaaacgccctgttcatattaatttgccgattgatgtgtataataaaccaattaataaacctacagaaccaattttatataaacagattttaagtaataaagaagcgttggataaaatgcttctacatgcaacttcaaaaataaaaaacgccaaaaaacctgtaattttagctgattttgaagtagatcgatttcatgctaaagaaaatttacatcaattcgtagaaaagactggctttcccatcgcaacgttaaatatgggaaaaggaatatttccagaaaaacaccctcaatttataggggtttatactggtgatgtaagttctccgtacttacgaaaaagaattgatgaatctgattgtattattagtattggtgtgaaattaactgatactattacaggcggcttcacacaaggttttacgaaagagcaagtgatagaaatccacccctatactgtgaaaattatagataaaaaatatggaccagttgtaatgaaagatgttttacaacagttaagtgatgtaattgaacatcgcaatgaggaaacacttgatattaagccatttatttcagaatcactatctattactgaagagtttaacccaaaagaacaaatgattacacaaaaacgtttttggcaacaaatataccactttttacacgaaaatgacattttaattgcagagcaaggaacacctttcttcggtagtgctactatccctttaccgaataacacaacatatgtagcgcaaccattatggggatcgatcggctatacattacctgccctacttggtacacagctcgctaatttatcgcggcgcaacattttagttattggtgatggttctttccaattaactgtccaagagttatcgactatactacggcaaaatttaaaaccgattatatttttaatcaataacaatggatacactgttgaacgtgcaattcgcggccaaaatcaaccgtataatgacatacaaatgtgggattacacaaaactaacgaacgtatttggaacagaagaaaaaagccaaacatttaaagtagaaaatgaaacagagttagcagaagtcttaacaaatataacttttaataagaatcaacttatctttattgaagttataatgagccaaagcgatcaacctgaattgttagctaaactcgggaaaagattcggtcagcaaaattcttaa

SEQ ID NO: 33 - DNA, 1641 bp, Staphylococcus epidermidis
atgaaacaacgcgtaggacaatatttaatggacgcagtttacgcagccggagttgacaaagtctttggtgtgccgggagatttcaacctagcctttttagacgatatcatttctcatgatcatatagaatggattggtaatacaaatgaattgaatgcaagttatgcaacagatggttatgcacgcattaacggattaggtgcaatggtgacaacatttggagttggtgaacttagtgcagttaacggcattgcaggttcatacgcagaacgtgtaccagtcattgccattactggagcacctactcgcgcagtagaagaagcaggtaaatttgtccaccattcacttggtgaaggtacatttgatgattatcgtaaaatgtttgaacctattacaactgcacaaggttatatcacacctgagaatgctactactgaaatcccaagattaattaatgcagcaatacaagaacgtcgcccagtacatttacacttacctatagatgtagcattagctgaaattgaagtttcagaaactttccaacctgaagcattaccacaacaagatgttcaaaaatatgtaaacatgattgaagataaactcaaatcagcatcacaaccacttattattgcaggtcatgaaattaatagtttcaacttgcatgaagaattagaagaaattgtagatcgtacgaatatacctgttgttcaattatcattaggtaaaggcgcatttaatgaagaaaaccctcattatgtaggaatattcgatggcgaaattgctgaagataagattaaagaatatgtaaataatagtgatgctattttaaatattggtgctaaattaacagactcagcaacagctggtttctcttatcaattcgatattgatgatgtcgtaatgattaatcacaagaacttcaagatgaatgacactgttgcaaatgatgtcacattacctagcttagtacatgcattgaagggtcttaattttaaaaatgaaaacgactaccctcaatacgaaagaccacaagcacacaattatgaacttaataatcaaccgttaactcaagaaacgtacttcaacatgatgcaagatttcatacaactggatgatgtcttaattgcagaacaaggtacctcattctttggtgcatatgatttagcattgtataaagacaatacgttcatcggacaaccattatggggttcaattggttatacattacctgctacattaggtacacaaattgctaatccacatcgtagaaacgtcttacttattggtgatggttctctacaattaacagtacaatcactatctacaatgattcgtcaagacttgaaaccaattatctttgtcatcaacaatgatggttatactgttgaaagaatgattcacggtatgaaagaaccatacaatgacattaagatgtgggattataaagcattacctgctgtattcggtggagacaatgtggcagtccatgatgtaaacaattcagaagaattaatgcaagcatttgaagatattaaagcgcataatgatcgtatgcattatgtcgaagtgaaaatggctgttgaagatgcgcctactaaacttagcgaaattgccaaagcgtttgcatctcaaaataaataa

SEQ ID NO: 34 - DNA, 1686 bp, Mycobacterium avium
atgactgatgctgcgaccgaacccgcatacaccgtcggtgactacctgttggaccgcctcgccgaactcggcgtctcggagatcttcggcgtcccgggtgattacaacctcgagttcctcgaccacatcgtcgcccaccccaggctgcgctgggtcggcaacgccaacgagctcaacgccggctacgccgcagacggatacggccggctgcgcggaatgtcagcgctggtaacgacattcggggtcggcgagctgtctgcggccaacgcggtggcgggcagttacgccgagcaggtgccggtggtgcacatcgtcggcggcccgtcgaaagacgcgcagggcaccaggcgcgcgctgcaccattcgctgggcgacggggacttcgagcacttcttccgggtcagccgcgaaatcacttgcgctcaagcaaatctcatgccagcgaccgcgcgcagagagatcgaccgggtgctgtcggaggtgcgcgagcagaagcgccccggttacatcctgctgtccaccgacgtggcccgcttccccaccgagccacccgaggctgcgctgccccgctacaccggcggcaccagcccccgcgcgctggcgatgttcaccgaggccgccgcggcactcatcggcgagcaccggatcaccgtgctggccgacctgctggtgcaccggctgcaggcgatcaaggagctcgaggcgctgctggcggccgacgtggtgccgcacgccacgctgatgtggggcaagagtctgctcgacgagagctcaccgaacttcctgggcatctacgcgggctcggccagcgcgccggcggtgcgcaccgcgatcgaagaggcgcccgtattggtcaccgccggggtggtgttcaccgacatggtcagcggcttcttcagccagcggatcgacccggcccggaccatcgacgtcgggcagtaccaaagcagtgtggccggagaggtgttcgcgccgttggagatgggcgaagcgcttcaggcgctggccgcgatcctcacacggcgcggggtctcctcgccgccggtggcctcgccgccggccgagccgctgccgccgcccccaccccgcgagcaaccgctgacccagaagatggtgtgggaccgggtgtgcacggccctcacaccgggcaacgtggtgctggccgaccagggcacctccttctacggcatggcagaccaccggttgccgcagggagtcaccttcatcggccaaccgctttggggctcaatcggttacacgctgcccgccgcgctcggcgccgcggtggcgcacccggaccgccggacggtgctgctgatcggggacggcgccgcgcagttgaccgtccaagagctcggcacctttgcccgcgaagggctttcccccgtcatcgtggtggtcaacaacgacggctacaccgtcgagcgggcgatccacggcgagacggcgccctacaacgacatcgtcgggtggaagtggacggaggtccccaactcgttgggcgtcacagatcacctggcgttccgggtgcagacctacggcgaactcgatgacgcgttgaccgccgccgcacggcaccaagaccggatggtgctggtcgaggtggtgctgccgcggctcgagatcccgcggctgctggtcgaactcgtgcgaccgacctcaccggacggcagcccgcgccgctag

SEQ ID NO: 35 - DNA, 1671 bp, Psycrobacter arcticus
atgagtcaacaatataccatcgctgattatttgtttgatcgtatcgcagaagcgggtgcatcagaggtatttggcgtacctggtgattttaacttaacttttttagacaatattatcgcctctgataagctgcgctgggtgggcaataccaatgagttaaatgcaggttacgcagctgatggctatgcacgtgagcgtgggtttgcggcgatggtgacgacctttggagtcggggagctgtctgctatcaatgccacggcaggctcgtttgcagagtatgcgccagtgcttcatatcgtaggcgcgccaagtacagcattacaagattcaaagcgccgcattcatcactcacttggtgatggcgtgttcaatcattttatcaaaatggtagagccggtcacggtagcacgggcgcaaattacgcctgaaaatgccgcctcagagattgaccgcgtgattcgcttgattcttaaaaagcatcgccctggttacttaatgctatcgcctgatgttgcgcgtcaacctatttatccaccgacgaccaagctcgttgatagccaagaagatattaccagtcaagcagcgctggcagattttaagcaagcactaatagcgttcttaccaaacaaaaccacgactctcatggcagatttgatggtgcatcgtttagggctgcaaaatcagcttaaggctttgattgctgatactgatattccttatacgacgttatcgtggggcaaaaccttactcgatgaaaacagcgatcgttgggcagggacttatgcgggcgttgcatcgcgccctgtggtcaaagatgcggtcgagaactgtgagtgtctgataaaaatcggtgtgcaatatactgacaccaccaccgcaggatttagtcaagatatcgatgaaaatgtcgtggttgatttgcattatgaacgtgctagtattgctggcaaaaactttgcgcccattgccctaaaagatgccctaaaaacactgcatgaggtgatgacttcagacattaatattgtgccgaagcagttctataaagaggtgaagccgcatgagcaacatggcaaggataatgaggctatccgtcaagatgacctctggcatatcattgccgatcatctagatcataataacttggtgtttgcagaacagggaacggcatattttggtatcagtgatgtacgtctaccagaaggcgtgacttgttatggacaaccaatgtgggggtccattggttatactttaccggcaagtttgggtgcagcgattgcatcaccaagcaagcgcagtgtcttgttgattggtgatggctcagcgttattaactatccaagagattgcagtgatgattcaagaacggatcaatccagtgattgtgctgattaataatgacggctataccgttgagcgagcgattcatggtgagaaccagcgctataatgacattcctaaatgtgattggcaagcgatgccaaaagcctttggtgcgacagaagaaaacagtctaatgcttaaggtagcaacagcgggtgagctaaaagcgtccctcgaaaaagccgctgctactacggacaagttggtcatgctagaggtaatagcggctaagcatgatatcccgccactactagctgatatcagcgctgcgcttaagccaaaagctgattaa

SEQ ID NO: 36 - DNA, 1674 bp, Corynebacterium striatum
atgcagaccaccgtcggcgaatttatcctcgaccgcctcaaggccatcggcatctccgagatcatcggagttcccggcgacttcaacttgagcttcctcgagcagatcgacgaggccgagggcatccgcttcgttggcgcctgcaacgagctcaatgcggcctacgccgctgatggttacgcccgccagcgcggcgtcggctgtctgctcaccacctacggcgtgggcgagctctccgcgctaaacggcatcgccggcgcccgcgctgagcacgtcccactcgtttccatcgccggcgctccgccgcagtacgccaccgagttccgctggaacctgcaccacacgcttgccgacggcgactttgccaacatgctcgatgccatcgcaccgtttaccgaggtagccacccgcgtttccccgatgaacgtggtcgaggaattcgaccgggccctgcacacctgcctgcgtgagaagcgcccagtgcacatccagatcccttccgacatcacccacttgaccatcgaggtcccggatacgcctttctccaccgagctggcttcctccgacaaggagcgcctcgaggctgcggccgatcgcgtgctggagcgcctcgctgccgctaaggacccgatcatcctcatcgatcaggacactaaccgccacggcttcgccgacaagttccgcgccatcatcgacaaggcccagctgccctactcgcagctttcctccggcaaggccatcctctccgagcgcgacccgctgttcatcggcacttacaacggcgcggcttctgccccgggcgtgcaggagcgcattgagaactccgacttcctggtcaccaccaaccctcgcttcatcgaggtcaactccggttccttcacccacgatctcgacaacgcgcacgtgttcaacttcggcgatcagcacctcaacgccgacggcgagttcttcgtaggaattaacacgctggagcttctcgacgtcctgctcgagcgcatccctgccaagaagccgatcggcggcgagaagttcgttccggagaccttcgaggtggaagccgacgccgccctgacgcaggctcgcatctggcagcagatgctgggattcatccaggaagacgacgttgttatcgctgaagcgggcacctccaacattggcctgggcccgcaacgcatgcctgaaggcgtgcagtacatcaactccaccatctggggctccatcggctttaccctaccggcagtactcggctcccagctggccaacccagagcgccgccacgtgctcttcatcggtgacggttccttccagctgaccgcccaagagctgtccaccatcctgcgccaggagctcaagcccatcatcgttctggtcaacaacgatggctacaccattgagcgcttcatcctcggcatggagcaggagtacaacgagatccagaactggaactacaacgaactgccgaaggtcttcaaggcggacaccaccatggagtcctactccgccaagaccgagggggaactcaaggacgctctggaagacatcgccgctcacccagaacgcggggcattcctcgaggtgcacctcgacccattcgatgcgccgaagggcctgcaggctttcggcccgctaaccgcagacttcgatttcggcccccgcggcccgcgcaacgcttaa

SEQ ID NO: 37 - DNA, 1671 bp, Bacillus megaterium
atgagtagcaactatacgatcggacattatttattagatcgtttagccgaattaggtgttcaccatatgtttggtgtacctggcgattataatttatcttttttagatgaagtcattgatcataaagaaatagaatggatcggaaattgtaatgagttaaatgcagcttatgctgctgatggctatgcaagagttaatggaatggccgcgctcattacaacatttggtgtcggtgaattaagtgctgttaacggtattgcaggatcttacgctgaacgtgtacccgtcgttaaaattacgggaactcctacaacaaatgtaatggataatggtttgtacgttcaccatacgcttggaaacggaaagttcgatcatttttcaactatgtataaagaagtaactgtagctcaaacgttccttacacaggaaaatgcagctcaagaaattgaccgcgtacttcttacatgctggactgacaaaaggcctgttcacattaatttgccaaccgacgtatatgataagcctattagcaaaccctacaactcattattagacagtgccattttaagtaacgaagaaacattgaaacaaatgatagtagacgttcccgaaagaatcaattcagccaaaaggcccgttatactggcagactttgaagtaactcgatacagagcacagaaagctttgctgcaattcgctgagaaaaccggttttcctgttgcaacattaagtatgggaaagagtgcttttaatgaagcacaccctcagtttatcggtgtttacaacggagatttaagttcttcttatgtgcaaaaacgtatagatcaatcagattgcatcatcagcgttggagtaaaattaacggattcaataacaggcggattttctcaccaattttcaaaggacaatgttattcatattcacccattttccgttcagtttaacagcacaaaatatgcacctgctacaatgattgattctttacacgcattaagcagtgcaattacaaaaagaaaagcggaagatttggatattctttctctcacttcacagatggctgctaaatcatatactgcagctgaaaccgagataacgcaagaaaggttctttgaacgaattgctgctttccttcatgaaaatgatgtactgttggcggaacaaggaacatcttttttcggagcagcaaccatgccgctgccaaaagacacaacatttatcggccagccgctttggggatctatcggctacacactccctgctcttttaggatcacagcttgctgacaaaaaccgacgcaacgtattgcttatcggcgacggttcatttcaattgacagcacaagagctgtcaactatgctgcgtcaacatattaaaccggtaatttttctaattaataatgacggctatacggtagaacgtgcgattcacggcgaaaatcaagtatataatgacattcaaatgtggaattatcaagagcttcccgctgtgttaggccctaaagaccggagtataacttttaaagttcgtacagaaatagagctggaggaagctttaatattggccgaacagaattatcaacatctcgtatttattgaggttatgatgcaccgagacgataaacctgctctgcttgccgaactttcaaaacgatttgcaaatcaaaacgtataa

SEQ ID NO: 38 - DNA, 1647 bp, Helicobacter mustelae
atgaagattagcattggacaatatcttttgaatcgattgaaagactatggtattgagcatatttttggtgtgcccggagattataatctaggctttttggatctgatagaagatgatgaggatttggaatggataggaaattgtaatgaactcaatgcctcatatgctgcagatggctatgctcgtattcgaccaatgggtgccttggtgagcacctttggtgtgggtgagctgagtgctatcaatggcattgctggggcatatgcagaaaatgtgcctgttgtcaaaattgttggcatgccatcaagaaatatttctctaaataagcgtcttgtgcatcacacgctgggagatggagaatttttgaagttttatcgcatgtatgaggaggttacagttgctcaaaccatcttaaacaagcaaaatgcaaaagaagagattgatcgtgtgttgcgagaatgtcatctacaaaaaaagccagtctacattggcataccagtggatgtgccaggcctgcagatcgaagcctctaagagtgtggactatcacccacaaagtgataaaaaaatcctagatgcattcattgctggcgtgaagaaagagctcttaggctcaaaagctcaaatcgtattagcagactatgaagtcaatcgctatgggctcaattctgcactccatgaatttattcaaaagaccaatctccctatagcctcgctgtctatggggaagggcgtgttcaaagagagtcaccccaattttgtgggtatctacaatggaattctaagtgatgaggctgtaacctcagccatcaagcaagcagattgcagtattcttattggcgtcaaactcactgactcgcttactgctgggtttaattacatctccaaggatcctccgacaattgaaatccatcccttccacagtcgcatcggagataaaatttatagtgacatcctgatgcaagatgtgctaaaaaaactctccgctctaaaatttcatccccatcgctccactcatacctccttgcccaagcaaaaacctcatccctcagataccctcactcaagagagattttttgggctcatagaaaagcacttagagcccaatgatgttttgatcgctgagcagggaacttcgttttttggctctgtggatgtcagactgcctgagggtgtgacatttgtctgccagcctttgtggggctcaattggctatacttttggtgcagtgctaggcacttgtctggcaaacaaagatcgcagaaatattttgctcattggtgatggttccttgcagctaaccgcccaagagctctcaaccatgctaagagagaatatcaacccaattatcattgtaatcaataatgatggctatacagtggagcgatgtatccatggcccaaatcgcaaatacaatgacattaatatgtggcattacacaaagctgattgatacatttgatgtcacgctaaagcgcgaggctttgatctttagagcttcttgtgtcaaagaattagaggaggcttttgaaagcgcaagggtgcatgcaaagcaactcgctcttatagaggttgtgatggatagagatgatgcaccagcactcctcaaaaaactaggagggcttttctccgcgcaaaatagctattaa

SEQ ID NO: 39 - DNA, 1665 bp, Clostridium acetobutylicum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 40 - DNA, 1641 bp, Macrococcus caseolyticus
atgaaacaaagaatcggtcaatacttaatcgatgcacttcatgttaacggtgtcgataaaatttttggggtaccgggagattttactttagcattccttgacgatatcattcgtcatgataatgtagagtgggtaggcaatacaaatgaactcaatgcagcctatgctgctgacggctatgcgagagttaacggacttgcagcagtaagtacaacatttggcgtaggagaactaagtgcagtaaacgggattgctggaagttatgctgaacgtgtgcctgtcataaaaatttcgggcggtccttcatctgtcgctcaacaagagggtcgctatgtccaccattcacttggtgaaggtattttcgattcctattcaaaaatgtatgcacatatcactgcgacgacaacaatactttctgtagacaatgcagtggatgaaattgaccgcgtgattcattgcgcactcaaagaaaagcgtcctgtgcacatccacctaccgatagatgttgctttgacagaaattgaaattccccatgcacctaaagtgtatacacatgaatcacaaaatgtcgatgcatatatccaggcagtagagaagaaactcatgtctgcaaaacaacctgtaattatagcgggacatgagatcaacagctttaaactacatgaacagctagagcagttcgtaaatcaaacgaatatacctgttgcacagctttctcttggcaaatctgcatttaatgaagaaaatgaacattacctagggatttatgacggtaagatcgctaaagaaaacgtgcgtgagtatgtggataatgcagatgtcatcttaaatataggtgcaaaactgacagattctgcaacagcaggtttctcatacaaattcgatactaataatattatctatattaaccataatgactttaaagctgaggatgttataagcgataatgtctcgctgattgatcttgtaaacggactgaatagtatcgactacaggaatgaaacacactacccatcatatcaacgttcggatatgaaatatgagttgaacgacgcacccttaacacaaagcaactacttcaaaatgatgaatgcattcttagaaaaagatgatattttacttgcagagcaaggcacatcattctttggtgcttatgatctatctttatataaagggaatcaatttatcggccagccgttatggggatcaatcggctatacattcccatctctattaggatctcagcttgctgatatgcatagacgtaacatcctgcttatcggtgacggttcattgcaattaactgttcaggcactatctacaatgatcagaaaagacattaagccgattatcttcgtaatcaataacgatggctatactgtagaacgtctgatacatggtatggaagaaccatacaatgacatccagatgtggaactacaaacagttaccagaagtatttggtggtaaagatacggttaaggtccacgatgcgaagacttcaaatgaattaaagacagttatggatagcgttaaagcagacaaagaccatatgcactttatcgaagtacatatggctgtagaagatgctccgaagaaattaatcgatatcgcaaaagctttctctgatgcgaacaaataa

SEQ ID NO: 41 - DNA, 1677 bp, Nostoc punctiforme
atggcaacgtttactgttggcgactatttattgcttcgtctggagcaaattggcatcaagcatatctttggcgttgctggagactacaatatggaatttctcgactatattgttaaccataatggcatcgagttaattcctacttgcaacgaacttaacgcatcctatgctgccgatggttatggtcggctcaatggtattgcggcattaataactacctttggtgttggtgaactcagtgctattaatggtgtcgctggcgcttatgctgaacacgttccggttgtagcgattactggtgctcctgcaactaaaattcaagctcttggttcacttgtccatcatacgcttggtactggtgatttctcaatgtttgcccgaatgtatgaacaggtaacggtggctcaagcatatttaacaaacgaaaatgcaacaacggaaattgacggagttttaggtatctgtttgctgaagaagttacctgtttatatttccatacctatggatgttgctctcacagaggtgtctgcaccgtctgattcctttatacccccagtattccagagtgatggcgctactttagccgaaatagttgatgtctgtgtaaacatactggaaaaagcttcccaacctgtgattcttgctgatattggtgtagctcgttatcacttgcatgaacaattgcgaaaactgctaacagctaccggatacccttatgccacgatgaatatgggaaaaggattgctagaagaaactcacccccaattcatcggtatatataatggtgctgccagtgaggaatctgtcagaaaacgtattgagcaggctgattgtgttttaactatcggtgctttgatgactgatttcaacacaggcaagttttctgccaaacttgaccccagccaaactattgaagtgcatgggcagtatgtaaaagttaaacatgctttatacaacaatgtagctatggcagatgtgctttctgctttaagtcaacggttgcagcgccgcgatcctcaaacgctaaacttcaaatcagcaacagagaatttagatgctggttttataacgccaatcgaaggcggctcttcggcaccaattacgcagcagtatttttggcatagatttgctcattttctccaagaagatgacattatcgttgctgagactggaacttgtttgtttggtgcctctatcgttcctttaccaaaaggagctactttcgttgggcaagtactttggggagcgattggctactctgttgcttcattacttggttgtgcgttggcgaagcccaccgcaggtatcgctgcatcacaacgtcgctctatcctactggttggtgacgggtctttccaaatgactgcacaagaactttcaactatcttacggtataacttaaaaccgattatttttttgatcaacaatgatggatatactatagagcgtgatattcatggtgaacgtatgccgtataacgacattcaaccttggaattatcatcagctccctaaggttttcggtggcaatggctggggaattaaagttagtaccgaatcccagttagataaagcattacaaacagctcaacaaaaccatgaccaacttgcttttattgaggttgtgatggataaaatggacagtccagaggttctgttgaagatgttgcagcaataa

SEQ ID NO: 42 - DNA, 1659 bp, Sarcina ventriculi
atgaaaataacaattgcagaatacttattaaaaagattaaaagaagtaaatgtagagcatatgtttggagttcctggagattataacttaggatttttagattatgttgaagattctaaagatattgaatgggttggaagctgtaatgaacttaatgcaggatatgcagcagatggatatgcaagacttagaggatttggtgtaatacttacaacttatggagttggttcacttagtgcaataaatgctacaacaggttcatttgcagaaaatgttccagtattacatatatcaggtgtaccatcagctttagttcaacaaaacagaaagctagttcaccattcaactgctagaggagaattcgacacttttgaaagaatgtttagagaaataacagaatttcaatcaatcataagcgaatataatgcagctgaagaaatcgatagagttatagaatcaatatataaatatcaattaccaggttatatagaattaccagttgatatagtttcaaaagaaatagaaatcgacgaaatgaaaccgctaaacttaactatgagaagcaacgagaaaactttagagaaattcgtaaatgatgtaaaagaaatggttgcaagctcaaaaggacaacatattttagctgattatgaagtattaagagctaaagctgaaaaagaattagaaggatttataaatgaagcaaaaatcccagtaaacactttaagtataggaaagacagcagtatcagaaagcaatccatactttgctggattattctcaggagaaactagttcagatttagttaaagaactttgcaaagcttctgatatagttttactatttggagttaaattcatagatactacaacagctggatttagatatataaataaagatgttaaaatgatagaaattggtttaactgattgtagaattggagaaactatttatactggactttacattaaagatgttataaaagctttaacagatgctaaaataaaattccataacgatgtaaaagtagaaagagaagcagtagaaaaatttgttccaacagatgctaaattaactcaagatagatatttcaaacaaatggaagcgttcttaaaacctaatgatgtattagttggtgaaacaggaacatcatatagtggagcatgtaatatgagattcccagaaggatcaagctttgtaggtcaaggatcttggatgtcaattggatatgctactcctgcagttttaggaactcatttagctgataagagcagaagaaacattcttttaagtggtgatggttcattccaattaacagttcaagaagtttcaacaatgataagacaaaaattaaatacagtattatttgtagttaacaatgatggatatacaattgaaagattaatccacggacctgaaagagaatataaccatattcaaatgtggcaatatgcagaacttgtaaaaacattagctactgaaagagatatacaaccaacttgtttcaaagttacaactgaaaaagaattagcagctgcaatggaagaaataaacaaaggaacagaaggtattgcttttgttgaagtagtaatggataaaatggatgctccaaaatcattaagacaagaagcaagtctatttagttctcaaaataactactaa

SEQ ID NO: 43 - DNA, 1686 bp, Bacillus thuringiensis
atgattcacttgaaaacgcaatatactgttagtacatatttattagaccgactaagcgaattaggaattgaacatatttttggtgtccctggtgattataatttggcttttttagatgatgtaatagcacatgaaaatgtagagtggattggcaattgtaatgaattaaatgcggcatatgctgctgatggatatgctcgtataaaaggaatcgctgctcttattaccactttcggtgttggagaattaagcgccattaacggtattgctggatcatatgccgaaaatgtacctgttataaaaattacggggacaccaccaacaacagtaatggaaaatggagcactcgttcatcatacgttaggtgatggaaagttcgatcatttttctaatatgtatagagaaatcacggtggcacaatcaaaattaacacctgagcatgccgctgaagaaattgaccgtgtgttacgtgcatgttggagtgcgaaacgccctgttcatattcaattaccgattgatgtgtataataaaccaattaataaacctacggaaccgattttacataaaccagttgtaagtaataaagatgcgctagataaaatgcttctacatgccacttcaaaaataaacagtgccaaaaaacctgtaattttagcggattttgaagtagaacgatttcacgctaaagaatatttatatcaattcgtagaaaaaactgggtttcccatcgcaacgttaagtatgggaaaaggaatattcccagaaaaacactctcaatttataggggtttatactggtgatgtaagttctccgtacttaagaaaaagaattgatgaatctgactgtattattagtattggtgtgaaattgactgatactattaccggcggattcacacaaggttttacgaaagaacaagttatagaaatccatccctacactgtcaaaattatagataaaaaatatggcccagttgtaatgaaagatgttttacaacagctaagtgatttaattgaacatcgcaataaaaatgatcttgaaatcaaaccatttctttcagaatcatcatcttttactgaagagttcaatccaaaagctcaaatggttacacaaaaacgtttttggcaacaaatataccatttcttacaagaaaacgatgttttaattgcagagcaaggaacacctttctttggtagtaccgctatccctttaccaaacaacactacatatgtagcgcaaccattatggggatcgatcggctatacattacctgctctacttggtacacagctcgctaatttatcgcggcgtaacattttaattattggtgatggttcttttcaattaactgtccaagaattatcaactatattacgtcaaaatttaaacccaattatatttttaattaataacaacggatatactgttgaacgtgcaattcatggtcaaaatgaaccatataatgacatacaaatgtgggattacacaaaactcgcaaacgtatttggatcaaaagaaaaaagcctaacatgtaaagtggaaaatgaaatagagttagaagaagtcttaactaagataagtattgataagaatcaacttgcctttgttgaagttgtaatgagccaaggggatcagcctgaattgttagctaaacttgggaaaagattcggccagcaaaattcttaa

SEQ ID NO: 44 - DNA, 1686 bp, Bacillus cereus
atgattctcttgaaaacgcaatatactgtaagtacatatttattagatcgattatacgaattaggaattgagcatatatttggtgttcctggtgattataatcttgcctttttagatgatgtgattgcacataaaaatttagagtggattggcaactgtaatgaattaaatgcggcatatgcagcagatggatatgctcgcataaaaggtgttgctgctcttattaccacttttggtgtgggggaattgagcgccataaacggcattgccggctcatatgccgaaaacgtaccagttataaaaattaccggtacaccaacaacaactgtaatggaaaatggagaactcgttcatcatacattaggtgatggaaagttcgatcacttttccaatatgtatcgagaaattactatagcacaaacaactttaatccctgagcatgccgctgaggaaattgaccgtgtactccgtgcatgttggaatgaaaaacgtccagtccatattaatttaccgatcgatgtatataataaaccaattaataaacctacggaaccaatcttaaatcatcccatagtaagtaataaagacgcattagataaaatgcttctacatgccatttcaaaaataaatagcgccaaaaaaccggttatattagctgattttgaagtgaatcgtttttatgctgaagaagatttacatcaactcgtagaaaaaactggcttccctatcgcttcactaagtatgggcaagggcatattcccagaaaaacatcctcaatttataggaatttacactggcgatgttagtcctccatacttgcgaaaaagagttgatgaatctgactgtatcattagtatcggtgtgaaattaactgatactattaccggtggctttacacaaggttttacgaaagaacaagttatagaaatccatccctatactgtgaaaattatagataaaaaatacggaccggttgtaatgaaagacgtattacaatatttaagtaattcaatcaagcatcgtaatgaagaaacgtttgaaattaagccatttatttcagaatcatcatctattactaaagagttcaatccaaaagcacaaatcgttacacaacaacgtttttggcaacaattgtaccacttcttacaagaaaacgacgtcttaattgcagagcaaggaacaccatacttcggtagtgccgctatccctttacctaataacgcttcatttgtaggacaaccattatggggatctatcggatatacacttcccgctctattaggaacacaactcgctaatgtaacacggcgtaacattttaattattggtgatggttctttccagttaactgttcaagaattatccactatgttacgtcataatttaaaaccaatcatatttttaattaataacaacggatatactgttgaacgagcgattcatggacgagaccaaccatataatgacatacaaatgtgggattataataaactgccaaatgtattcggatcagaagaaaaaagtctcacatttaaagtagaaaatgaaatagagttagcagaagtcttaaataaaataagttttaatatgaatcgacttatctttattgaagttgtaatgagccaaggggatcagcctgaattgttagctaaacttagaaaaagattcggcatccaaaattcttaa

SEQ ID NO: 45 - DNA, 1644 bp, Lactococcus lactis
atgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatag

SEQ ID NO: 46 - protein, 550 aa, Erwinia amylovora
MSTYTVGDYLLTRLNEIGISHLFGVPGDYNLRFLDHVIDHPDVDWVGCANELNAAYAADGYARCRGAGALLTTFGVGELSAINGVAGSSAEYLPVIHIVGAPSQTSQNKGELLHHTLGDGDFGHFIRMQQEISVASSVLTTANAAAEIDRVLFEALTKRRPVYLLLATNVAESPLSPPSSPLELRLDCDKAQLAAFVDAAESLLAPASSVAMLADFLADRAQQQQRLQRWLEEIPMPFATLLMGKSVLPEMLTGFVGTYAGAASADSTRAVIENSDVLISVGVRYTDSITAGFTQQITCSKNIDVGLHSSSVAGQPFEPVPMAAALEALYQLARKYGQGWQRGIVAPPVSEEQSSDGLTQDTFWHALQDFLRPGDIVLADQGTAAFGAAALRLPQDVRLLVQPLWGSIGYTLPAAFGAQTARPQQRVVLIIGDGSAQLTVQELGSILRDGQKPVIFLLNNDGYTVERAIHGAQQRYNDIARWDWTRLPQTLGIDSLAQSWRVTQTVQLREVMKLLQEGGHLSLVEVVLPRLDVPPLLASVCHALNQRNNS

SEQ ID NO: 47 - protein, 542 aa, Thauera sp.
MNLTESLLHALVDHGARQIFGIPGDFALPYFRIIEQTGILPLHTLSHEPGVGFAADAAARVQGGIGVAAVTYGAGALNMVNAVAAAYAEKSPLVVISGGPGLGESQSGLLLHHQAKTLDSQLRIFQEITCDQVRLDDAARAPADIARVLGNCVRNSLPVYIEIPRDMVARPCAPVVREAPRAVDADALAACVDEILARLRAARAPVLMAGVEVRRFGLEDKVAELSRRLGIPVVTSFMGRGLLADQDAPLMGTYMGLAGLPEVSALVEDSDGLFLVGVIISDTNFAVSGKHIDLRHTIQALEARVTMGYHTYADIPLDALIDGLLARVPHADAHFTVDRPAFPHGLQADEATIAPADIACAVNDLMAAHGKLPIASDMGDCLFTAMDIEHTALVAPGYYATMGFGVPAGLGVQAATGQRPLILVGDGAFQMTGWELGNCRRYGWDPIVLLFNNASWEMLRTFQPESGFNDLDDWGFAQMAAGLGGDGVRVHTRAQLKAALDKAIATRGRFQLIEVMIPRGVLSESLSRFVNAVKRLNAAKAA

SEQ ID NO: 48 - protein, 550 aa, Frankia sp.
MVTTVIQHVLNRLRDLGIRHVFGVPGDYAFPVDDAVIAHPDIQWMGNCNELNAAYCADGYARVHGMGAVSTTYGVGELSAINGIAGAYTEHLPVFHLVGMPKMPVQARHALVHHTLGNGEFDLFQRMSDPVVCASAIMTPQNVAAETERLIAAAIYHRRPVYLAFPADLAELPVASEAPELPAPASDPAQLDAAVAAVADRLRHAGSACLLPGALAVRAGLGRHLQRLVDASGLPFATMVADKGVLDEDQPGFVGMYDGKLMNEDVRRLVEDGDVVVLVGALMHDFNSGAFTANLDPARTVDIRHHHVQVGAMTYPSVEMRDLLTALAARLPTRTWPRPSAGVVRMRSEPGSGDDPLTAGTLYPRWERFLRPRDIVVAETGTCSMGMAFARLPYGATFENQTLWGSIGWATPAAVGAAVAAGPDRRVVLITGEGSHQLTAQEISQFGRYRLRPVVFVLNNSGYLIERLLCKHPDLAYNDLARWHYAELPRVLGCEDWFTARVSTCAELDRALDTARHASTGCYIEVLTDSHAAPPLATRMHENLGSLYAG

SEQ ID NO: 49 - protein, 573 aa, Acinetobacter sp.
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGIGARFTDVGSAVFTHQIETRNYIEIKSYGLNIFGQDFPGIEIGQLLVELNKKVAPRKSSVPLLEKQPQKVVEAPAQQRLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPIKCKDASSF

SEQ ID NO: 50 - protein, 541 aa, Anabaena variabilis
MPQLAPHIFDILYQKGVEHAFGIPGDFALTLFDALADSKIAPIVMTHEPCVGFAADAYSRMRGLGLAVVTYSVGGLNMVNAVAGAYAEKSPLVILSGGPGVREQKEHDLLHHKVKTFDTQRRVYEEVTLYATKLTDPKTADAKIHHALDYATTFKRPVYLEIPRDLVYAEITESEHLPPPIKRTDPDTLTEAIAETLEMLKRSHSPVILACVEVHRFGLQEQLLALAEKLGVPVCSTMLGKSVFPERHPQYIGIYNGEAGDLNVQKIVEESDCVLMLGVFMTDINLGMFTAHLNPGFTVYATSERLAIKHHEYPNVRFEDYITTLLDSPDLPHWDSSGIYTMKPRVTPSVGKISMSGLLYELNQFIDSNTLLVTDVGDALFAADDIQTQQGTSFLCPAFYASMGFGVPGVIGAQLADPSRRAIALVGDGAFHMTGMELLTAQRLRLNPIVIVINNGSFASLQAMGHQEAAFVQIPTMDYAQLANVLGGHGFVIHTSTQLQQALQTAQNSKTFSILDVHLSPDDVSPALQRLSALFTKSLKG

SEQ ID NO: 51 - protein, 574 aa, Mycobacterium kansasii
MVSAGRTVVFVTDRAAGPNEPVYTVGDYLLDRLAELGVSEIFGVPGDYNLEFLDHIVAHPAIRWVGNANELNAGYAADGYGRLRGMSAVVTTFGVGELSAANAIAGSYAEHVPVVHIVGGPSKDAQGTRRALHHSLGDGDFEHFFRISREITCAQANLMPATACREIDRVLCEVREQKRPGYLLLSTDVARFPTEPPGAPLPPYGGGTSPRALSLFTEAAAALIGEHQLTVLADLLVHRLRAVDELEALLAADVVPHATLMWGKSLLDESSPNFLGIYAGAASAARVRAAIEQAPVLVTAGVVFTDMVSGFFSQRIDPARTIDIGQYQSTVAGRVFAPLEMSAALRAIAEILTGRGITSPPVPAPDDHRPASTPQRDDPLTQRMLWDRVNDALTPGNVVLAEQGTSFYGMADHRLPHGVTFIGQPLWGSIGYTLPAALGAAVAHRDRRTVLLIGDGAAQLTVQEIGNFSREGLSPVIVVVNNDGYTIERAIHGETASYNDIAAWSWTAVPSALGVTDHLAFRARTYGELDDALTAAAAHRDRLVLVEAVLPRLEIPHLLSDLVAPTSSDGTARR

SEQ ID NO: 52 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 53 - protein, 561 aa, Bacillus thuringiensis
MIHLKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPILYKQILSNKEALDKMLLHATSKIKNAKKPVILADFEVDRFHAKENLHQFVEKTGFPIATLNMGKGIFPEKHPQFIGVYTGDVSSPYLRKRIDESDCIISIGVKLTDTITGGFTQGFTKEQVIEIHPYTVKIIDKKYGPVVMKDVLQQLSDVIEHRNEETLDIKPFISESLSITEEFNPKEQMITQKRFWQQIYHFLHENDILIAEQGTPFFGSATIPLPNNTTYVAQPLWGSIGYTLPALLGTQLANLSRRNILVIGDGSFQLTVQELSTILRQNLKPIIFLINNNGYTVERAIRGQNQPYNDIQMWDYTKLTNVFGTEEKSQTFKVENETELAEVLTNITFNKNQLIFIEVIMSQSDQPELLAKLGKRFGQQNS

SEQ ID NO: 54 - protein, 546 aa, Staphylococcus epidermidis
MKQRVGQYLMDAVYAAGVDKVFGVPGDFNLAFLDDIISHDHIEWIGNTNELNASYATDGYARINGLGAMVTTFGVGELSAVNGIAGSYAERVPVIAITGAPTRAVEEAGKFVHHSLGEGTFDDYRKMFEPITTAQGYITPENATTEIPRLINAAIQERRPVHLHLPIDVALAEIEVSETFQPEALPQQDVQKYVNMIEDKLKSASQPLIIAGHEINSFNLHEELEEIVDRTNIPVVQLSLGKGAFNEENPHYVGIFDGEIAEDKIKEYVNNSDAILNIGAKLTDSATAGFSYQFDIDDVVMINHKNFKMNDTVANDVTLPSLVHALKGLNFKNENDYPQYERPQAHNYELNNQPLTQETYFNMMQDFIQLDDVLIAEQGTSFFGAYDLALYKDNTFIGQPLWGSIGYTLPATLGTQIANPHRRNVLLIGDGSLQLTVQSLSTMIRQDLKPIIFVINNDGYTVERMIHGMKEPYNDIKMWDYKALPAVFGGDNVAVHDVNNSEELMQAFEDIKAHNDRMHYVEVKMAVEDAPTKLSEIAKAFASQNK

SEQ ID NO: 55 - protein, 561 aa, Mycobacterium avium
MTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALAAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNSLGVTDHLAFRVQTYGELDDALTAAARHQDRMVLVEVVLPRLEIPRLLVELVRPTSPDGSPRR

SEQ ID NO: 56 - protein, 556 aa, Psychrobacter arcticus
MSQQYTIADYLFDRIAEAGASEVFGVPGDFNLTFLDNIIASDKLRWVGNTNELNAGYAADGYARERGFAAMVTTFGVGELSAINATAGSFAEYAPVLHIVGAPSTALQDSKRRIHHSLGDGVFNHFIKMVEPVTVARAQITPENAASEIDRVIRLILKKHRPGYLMLSPDVARQPIYPPTTKLVDSQEDITSQAALADFKQALIAFLPNKTTTLMADLMVHRLGLQNQLKALIADTDIPYTTLSWGKTLLDENSDRWAGTYAGVASRPVVKDAVENCECLIKIGVQYTDTTTAGFSQDIDENVVVDLHYERASIAGKNFAPIALKDALKTLHEVMTSDINIVPKQFYKEVKPHEQHGKDNEAIRQDDLWHIIADHLDHNNLVFAEQGTAYFGISDVRLPEGVTCYGQPMWGSIGYTLPASLGAAIASPSKRSVLLIGDGSALLTIQEIAVMIQERINPVIVLINNDGYTVERAIHGENQRYNDIPKCDWQAMPKAFGATEENSLMLKVATAGELKASLEKAAATTDKLVMLEVIAAKHDIPPLLADISAALKPKAD

SEQ ID NO: 57 - protein, 557 aa, Corynebacterium striatum
MQTTVGEFILDRLKAIGISEIIGVPGDFNLSFLEQIDEAEGIRFVGACNELNAAYAADGYARQRGVGCLLTTYGVGELSALNGIAGARAEHVPLVSIAGAPPQYATEFRWNLHHTLADGDFANMLDAIAPFTEVATRVSPMNVVEEFDRALHTCLREKRPVHIQIPSDITHLTIEVPDTPFSTELASSDKERLEAAADRVLERLAAAKDPIILIDQDTNRHGFADKFRAIIDKAQLPYSQLSSGKAILSERDPLFIGTYNGAASAPGVQERIENSDFLVTTNPRFIEVNSGSFTHDLDNAHVFNFGDQHLNADGEFFVGINTLELLDVLLERIPAKKPIGGEKFVPETFEVEADAALTQARIWQQMLGFIQEDDVVIAEAGTSNIGLGPQRMPEGVQYINSTIWGSIGFTLPAVLGSQLANPERRHVLFIGDGSFQLTAQELSTILRQELKPIIVLVNNDGYTIERFILGMEQEYNEIQNWNYNELPKVFKADTTMESYSAKTEGELKDALEDIAAHPERGAFLEVHLDPFDAPKGLQAFGPLTADFDFGPRGPRNA

SEQ ID NO: 58 - protein, 556 aa, Bacillus megaterium
MSSNYTIGHYLLDRLAELGVHHMFGVPGDYNLSFLDEVIDHKEIEWIGNCNELNAAYAADGYARVNGMAALITTFGVGELSAVNGIAGSYAERVPVVKITGTPTTNVMDNGLYVHHTLGNGKFDHFSTMYKEVTVAQTFLTQENAAQEIDRVLLTCWTDKRPVHINLPTDVYDKPISKPYNSLLDSAILSNEETLKQMIVDVPERINSAKRPVILADFEVTRYRAQKALLQFAEKTGFPVATLSMGKSAFNEAHPQFIGVYNGDLSSSYVQKRIDQSDCIISVGVKLTDSITGGFSHQFSKDNVIHIHPFSVQFNSTKYAPATMIDSLHALSSAITKRKAEDLDILSLTSQMAAKSYTAAETEITQERFFERIAAFLHENDVLLAEQGTSFFGAATMPLPKDTTFIGQPLWGSIGYTLPALLGSQLADKNRRNVLLIGDGSFQLTAQELSTMLRQHIKPVIFLINNDGYTVERAIHGENQVYNDIQMWNYQELPAVLGPKDRSITFKVRTEIELEEALILAEQNYQHLVFIEVMMHRDDKPALLAELSKRFANQNV

SEQ ID NO: 59 - protein, 548 aa, Helicobacter mustelae
MKISIGQYLLNRLKDYGIEHIFGVPGDYNLGFLDLIEDDEDLEWIGNCNELNASYAADGYARIRPMGALVSTFGVGELSAINGIAGAYAENVPVVKIVGMPSRNISLNKRLVHHTLGDGEFLKFYRMYEEVTVAQTILNKQNAKEEIDRVLRECHLQKKPVYIGIPVDVPGLQIEASKSVDYHPQSDKKILDAFIAGVKKELLGSKAQIVLADYEVNRYGLNSALHEFIQKTNLPIASLSMGKGVFKESHPNFVGIYNGILSDEAVTSAIKQADCSILIGVKLTDSLTAGFNYISKDPPTIEIHPFHSRIGDKIYSDILMQDVLKKLSALKFHPHRSTHTSLPKQKPHPSDTLTQERFFGLIEKHLEPNDVLIAEQGTSFFGSVDVRLPEGVTFVCQPLWGSIGYTFGAVLGTCLANKDRRNILLIGDGSLQLTAQELSTMLRENINPIIIVINNDGYTVERCIHGPNRKYNDINMWHYTKLIDTFDVTLKREALIFRASCVKELEEAFESARVHAKQLALIEVVMDRDDAPALLKKLGGLFSAQNSY

SEQ ID NO: 60 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 61 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

SEQ ID NO: 62 - protein, 558 aa, Nostoc punctiforme
MATFTVGDYLLLRLEQIGIKHIFGVAGDYNMEFLDYIVNHNGIELIPTCNELNASYAADGYGRLNGIAALITTFGVGELSAINGVAGAYAEHVPVVAITGAPATKIQALGSLVHHTLGTGDFSMFARMYEQVTVAQAYLTNENATTEIDGVLGICLLKKLPVYISIPMDVALTEVSAPSDSFIPPVFQSDGATLAEIVDVCVNILEKASQPVILADIGVARYHLHEQLRKLLTATGYPYATMNMGKGLLEETHPQFIGIYNGAASEESVRKRIEQADCVLTIGALMTDFNTGKFSAKLDPSQTIEVHGQYVKVKHALYNNVAMADVLSALSQRLQRRDPQTLNFKSATENLDAGFITPIEGGSSAPITQQYFWHRFAHFLQEDDIIVAETGTCLFGASIVPLPKGATFVGQVLWGAIGYSVASLLGCALAKPTAGIAASQRRSILLVGDGSFQMTAQELSTILRYNLKPIIFLINNDGYTIERDIHGERMPYNDIQPWNYHQLPKVFGGNGWGIKVSTESQLDKALQTAQQNHDQLAFIEVVMDKMDSPEVLLKMLQQ

SEQ ID NO: 63 - protein, 552 aa, Sarcina ventriculi
MKITIAEYLLKRLKEVNVEHMFGVPGDYNLGFLDYVEDSKDIEWVGSCNELNAGYAADGYARLRGFGVILTTYGVGSLSAINATTGSFAENVPVLHISGVPSALVQQNRKLVHHSTARGEFDTFERMFREITEFQSIISEYNAAEEIDRVIESIYKYQLPGYIELPVDIVSKEIEIDEMKPLNLTMRSNEKTLEKFVNDVKEMVASSKGQHILADYEVLRAKAEKELEGFINEAKIPVNTLSIGKTAVSESNPYFAGLFSGETSSDLVKELCKASDIVLLFGVKFIDTTTAGFRYINKDVKMIEIGLTDCRIGETIYTGLYIKDVIKALTDAKIKFHNDVKVEREAVEKFVPTDAKLTQDRYFKQMEAFLKPNDVLVGETGTSYSGACNMRFPEGSSFVGQGSWMSIGYATPAVLGTHLADKSRRNILLSGDGSFQLTVQEVSTMIRQKLNTVLFVVNNDGYTIERLIHGPEREYNHIQMWQYAELVKTLATERDIQPTCFKVTTEKELAAAMEEINKGTEGIAFVEVVMDKMDAPKSLRQEASLFSSQNNY

SEQ ID NO: 64 - protein, 561 aa, Bacillus thuringiensis
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDRVLRACWSAKRPVHIQLPIDVYNKPINKPTEPILHKPVVSNKDALDKMLLHATSKINSAKKPVILADFEVERFHAKEYLYQFVEKTGFPIATLSMGKGIFPEKHSQFIGVYTGDVSSPYLRKRIDESDCIISIGVKLTDTITGGFTQGFTKEQVIEIHPYTVKIIDKKYGPVVMKDVLQQLSDLIEHRNKNDLEIKPFLSESSSFTEEFNPKAQMVTQKRFWQQIYHFLQENDVLIAEQGTPFFGSTAIPLPNNTTYVAQPLWGSIGYTLPALLGTQLANLSRRNILIIGDGSFQLTVQELSTILRQNLNPIIFLINNNGYTVERAIHGQNEPYNDIQMWDYTKLANVFGSKEKSLTCKVENEIELEEVLTKISIDKNQLAFVEVVMSQGDQPELLAKLGKRFGQQNS

SEQ ID NO: 65 - protein, 561 aa, Bacillus cereus
MILLKTQYTVSTYLLDRLYELGIEHIFGVPGDYNLAFLDDVIAHKNLEWIGNCNELNAAYAADGYARIKGVAALITTFGVGELSAINGIAGSYAENVPVIKITGTPTTTVMENGELVHHTLGDGKFDHFSNMYREITIAQTTLIPEHAAEEIDRVLRACWNEKRPVHINLPIDVYNKPINKPTEPILNHPIVSNKDALDKMLLHAISKINSAKKPVILADFEVNRFYAEEDLHQLVEKTGFPIASLSMGKGIFPEKHPQFIGIYTGDVSPPYLRKRVDESDCIISIGVKLTDTITGGFTQGFTKEQVIEIHPYTVKIIDKKYGPVVMKDVLQYLSNSIKHRNEETFEIKPFISESSSITKEFNPKAQIVTQQRFWQQLYHFLQENDVLIAEQGTPYFGSAAIPLPNNASFVGQPLWGSIGYTLPALLGTQLANVTRRNILIIGDGSFQLTVQELSTMLRHNLKPIIFLINNNGYTVERAIHGRDQPYNDIQMWDYNKLPNVFGSEEKSLTFKVENEIELAEVLNKISFNMNRLIFIEVVMSQGDQPELLAKLRKRFGIQNS

SEQ ID NO: 66 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 67 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSWFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 68 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 69 - DNA, 11856 bp, Artificial sequence
  Synthetic construct-pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 70 - DNA, 15539 bp, Artificial sequence
  Synthetic construct-pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 71 - DNA, 7463 bp, Artificial sequence
  Synthetic construct pRS423::pGAL1-cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttatgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 72 - DNA, 4586 bp, Artificial sequence
  Synthetic construct-pLA54
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 73 - DNA, 80 bp, Artificial sequence
  primer BK505
ttccggtttctttgaaatttttttgattcggtaatctccgagcagaaggagcattgcggattacgtattctaatgttcag

SEQ ID NO: 74 - DNA, 81 bp, Artificial sequence
  primer BK506
gggtaataactgatataattaaattgaagctctaatttgtgagtttagtacaccttggctaactcgttgtatcatcactgg

SEQ ID NO: 75 - DNA, 38 bp, Artificial sequence
  primer LA468
gcctcgagttttaatgttacttctcttgcagttaggga

SEQ ID NO: 76 - DNA, 31 bp, Artificial sequence
  primer LA492
gctaaattcgagtgaaacacaggaagaccag

SEQ ID NO: 77 - DNA, 24 bp, Artificial sequence
  primer oBP452
ttctcgacgtgggcctttttcttg

SEQ ID NO: 78 - DNA, 49 bp, Artificial sequence
  primer oBP453
tgcagctttaaataatcggtgtcactactttgccttcgtttatcttgcc

SEQ ID NO: 79 - DNA, 49 bp, Artificial sequence
  primer oBP454
gagcaggcaagataaacgaaggcaaagtagtgacaccgattatttaaag

SEQ ID NO: 80 - DNA, 49 bp, Artificial sequence
  primer oBP455
tatggaccctgaaaccacagccacattgtaaccaccacgacggttgttg

SEQ ID NO: 81 - DNA, 49 bp, Artificial sequence
  primer oBP456
tttagcaacaaccgtcgtggtggttacaatgtggctgtggtttcagggt

SEQ ID NO: 82 - DNA, 49 bp, Artificial sequence
  primer oBP457
ccagaaaccctatacctgtgtggacgtaaggccatgaagctttttcttt

SEQ ID NO: 83 - DNA, 49 bp, Artificial sequence
  primer oBP458
attggaaagaaaaagcttcatggccttacgtccacacaggtatagggtt

SEQ ID NO: 84 - DNA, 22 bp, Artificial sequence
  primer oBP459
cataagaacacctttggtggag

SEQ ID NO: 85 - DNA, 22 bp, Artificial sequence
  primer oBP460
aggattatcattcataagtttc

SEQ ID NO: 86 - DNA, 23 bp, Artificial sequence
  primer oBP461
ttcttggagctgggacatgtttg

SEQ ID NO: 87 - DNA, 22 bp, Artificial sequence
  primer oBP450
tgatgatatttcataaataatg

SEQ ID NO: 88 - DNA, 23 bp, Artificial sequence
  primer oBP451
atgcgtccatctttacagtcctg

SEQ ID NO: 89 - DNA, 22 bp, Artificial sequence
  primer oBP440
tacgtacggaccaatcgaagtg

SEQ ID NO: 90 - DNA, 49 bp, Artificial sequence
  primer oBP441
aattcgtttgagtacactactaatggctttgttggcaatatgtttttgc

SEQ ID NO: 91 - DNA, 49 bp, Artificial sequence
  primer oBP442
atatagcaaaaacatattgccaacaaagccattagtagtgtactcaaac

SEQ ID NO: 92 - DNA, 49 bp, Artificial sequence
  primer oBP443
tatggaccctgaaaccacagccacattcttgttatttataaaaagacac

SEQ ID NO: 93 - DNA, 49 bp, Artificial sequence
  primer oBP444
ctcccgtgtctttttataaataacaagaatgtggctgtggtttcagggt

SEQ ID NO: 94 - DNA, 49 bp, Artificial sequence
  primer oBP445
taccgtaggcgtccttaggaaagatagaaggccatgaagctttttcttt

SEQ ID NO: 95 - DNA, 49 bp, Artificial sequence
  primer oBP446
attggaaagaaaaagcttcatggccttctatctttcctaaggacgccta

SEQ ID NO: 96 - DNA, 21 bp, Artificial sequence
  primer oBP447
ttattgtttggcatttgtagc

SEQ ID NO: 97 - DNA, 22 bp, Artificial sequence
  primer oBP448
ccaagcatctcataaacctatg

SEQ ID NO: 98 - DNA, 22 bp, Artificial sequence
  primer oBP449
tgtgcagatgcagatgtgagac

SEQ ID NO: 99 - DNA, 17 bp, Artificial sequence
  primer oBP554
agttattgataccgtac

SEQ ID NO: 100 - DNA, 19 bp, Artificial sequence
  primer oBP555
cgagataccgtaggcgtcc

SEQ ID NO: 101 - DNA, 2237 bp, Artificial sequence
  Synthetic construct-PDC1 Fragment A-ilvDSm
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 102 - DNA, 24 bp, Artificial sequence
  primer oBP513
ttatgtatgctcttctgacttttc

SEQ ID NO: 103 - DNA, 49 bp, Artificial sequence
  primer oBP515
aataattagagattaaatcgctcattttttgccagtttcttcaggcttc

SEQ ID NO: 104 - DNA, 49 bp, Artificial sequence
  primer oBP516
agcctgaagaaactggcaaaaaatgagcgatttaatctctaattattag

SEQ ID NO: 105 - DNA, 49 bp, Artificial sequence
  primer oBP517
tatggaccctgaaaccacagccacatttttcaatcattggagcaatcat

SEQ ID NO: 106 - DNA, 49 bp, Artificial sequence
  primer oBP518
taaaatgattgctccaatgattgaaaaatgtggctgtggtttcagggtc

SEQ ID NO: 107 - DNA, 49 bp, Artificial sequence
  primer oBP519
accgtaggtgttgtttgggaaagtggaaggccatgaagctttttctttc

SEQ ID NO: 108 - DNA, 49 bp, Artificial sequence
  primer oBP520
ttggaaagaaaaagcttcatggccttccactttcccaaacaacacctac

SEQ ID NO: 109 - DNA, 23 bp, Artificial sequence
  primer oBP521
ttattgcttagcgttggtagcag

SEQ ID NO: 110 - DNA, 21 bp, Artificial sequence
  primer oBP511
tttttggtggttccggcttcc

SEQ ID NO: 111 - DNA, 22 bp, Artificial sequence
  primer oBP512
aaagttggcatagcggaaactt

SEQ ID NO: 112 - DNA, 16 bp, Artificial sequence
  primer oBP550
gtcattgacaccatct

SEQ ID NO: 113 - DNA, 19 bp, Artificial sequence
  primer oBP551
agagataccgtaggtgttg

SEQ ID NO: 114 - DNA, 57 bp, Artificial sequence
  primer oBP438
aattggatccggcgcgccgtttaaacggccggccaatgtggctgtggtttcagggtc

SEQ ID NO: 115 - DNA, 49 bp, Artificial sequence
  primer oBP439
aatttctagattaattaagcggccgcaaggccatgaagctttttctttc

SEQ ID NO: 116 - DNA, 2686 bp, Artificial sequence
  Synthetic construct-pUC19
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 117 - DNA, 21 bp, Artificial sequence
  primer oBP264
tcggtgcgggcctcttcgcta

SEQ ID NO: 118 - DNA, 21 bp, Artificial sequence
  primer oBP265
aatgtgagttagctcactcat

SEQ ID NO: 119 - DNA, 15456 bp, Artificial sequence
  Synthetic construct-pLH468-sadB
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 120 - DNA, 33 bp, Artificial sequence
  primer oBP530
aattggcgcgccatgaaagctctggtttatcac

SEQ ID NO: 121 - DNA, 49 bp, Artificial sequence
  primer oBP531
tgaatcatgagttttatgttaattagctcaggcagcgcctgcgttcgag

SEQ ID NO: 122 - DNA, 49 bp, Artificial sequence
  primer oBP532
atcctctcgaacgcaggcgctgcctgagctaattaacataaaactcatg

SEQ ID NO: 123 - DNA, 34 bp, Artificial sequence
  primer oBP533
aattgtttaaacaagtaaataaattaatcagcat

SEQ ID NO: 124 - DNA, 49 bp, Artificial sequence
  primer oBP536
acacaatacaataacaagaagaacaaaatgaaagctctggtttatcacg

SEQ ID NO: 125 - DNA, 49 bp, Artificial sequence
  primer oBP546
agcgtatacatctgttgggaaagtagaaggccatgaagctttttctttc

SEQ ID NO: 126 - DNA, 49 bp, Artificial sequence
  primer oBP547
ttggaaagaaaaagcttcatggccttctactttcccaacagatgtatac

SEQ ID NO: 127 - DNA, 22 bp, Artificial sequence
  primer oBP539
ttattgtttagcgttagtagcg

SEQ ID NO: 128 - DNA, 3521 bp, Artificial sequence
  Synthetic construct-PDC5A-sadB-BUC cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 129 - DNA, 72 bp, Artificial sequence
  primer oBP542
cataatcaatctcaaagagaacaacacaatacaataacaagaagaacaaaatgaaagctctggtttatcacg

SEQ ID NO: 130 - DNA, 21 bp, Artificial sequence
  primer oBP540
taggcataatcaccgaagaag

SEQ ID NO: 131 - DNA, 21 bp, Artificial sequence
  primer oBP541
aaaatggtaagcagctgaaag

SEQ ID NO: 132 - DNA, 17 bp, Artificial sequence
  primer oBP552
agttgttagaactgttg

SEQ ID NO: 133 - DNA, 19 bp, Artificial sequence
  primer oBP553
gacgatagcgtatacatct

SEQ ID NO: 134 - DNA, 1685 bp, Artificial sequence
  Synthetic construct-gpd2::loxP-URA3-loxP cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

SEQ ID NO: 135 - DNA, 1559 bp, Artificial sequence
  Synthetic construct-loxP-URA3-loxP
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 136 - DNA, 90 bp, Artificial sequence
  primer LA512
gtattttggtagattcaattctctttccctttccttttccttcgctccccttccttatcagcattgcggattacgtattctaatgttcag

SEQ ID NO: 137 - DNA, 90 bp, Artificial sequence
  primer LA513
ttggttgggggaaaaagaggcaacaggaaagatcagagggggagggggggggagagtgtcaccttggctaactcgttgtatcatcactgg

SEQ ID NO: 138 - DNA, 22 bp, Artificial sequence
  primer oBP582
cttagcctctagccatagccat

SEQ ID NO: 139 - DNA, 23 bp, Artificial sequence
  primer AA270
ttagttttgctggccgcatcttc

SEQ ID NO: 140 - DNA, 21 bp, Artificial sequence
  primer oBP591
cccattaatatactattgaga

SEQ ID NO: 141 - DNA, 22 bp, Artificial sequence
  primer oBP594
agctgtctcgtgttgtgggttt

SEQ ID NO: 142 - DNA, 49 bp, Artificial sequence
  primer oBP595
cttaataatagaacaatatcatcctttacgggcatcttatagtgtcgtt

SEQ ID NO: 143 - DNA, 49 bp, Artificial sequence
  primer oBP596
gcgccaacgacactataagatgcccgtaaaggatgatattgttctatta

SEQ ID NO: 144 - DNA, 49 bp, Artificial sequence
  primer oBP597
tatggaccctgaaaccacagccacattgcaacgacgacaatgccaaacc

SEQ ID NO: 145 - DNA, 49 bp, Artificial sequence
  primer oBP598
tccttggtttggcattgtcgtcgttgcaatgtggctgtggtttcagggt

SEQ ID NO: 146 - DNA, 49 bp, Artificial sequence
  primer oBP599
atcctctcgcggagtccctgttcagtaaaggccatgaagctttttcttt

SEQ ID NO: 147 - DNA, 49 bp, Artificial sequence
  primer oBP600
attggaaagaaaaagcttcatggcctttactgaacagggactccgcgag

SEQ ID NO: 148 - DNA, 22 bp, Artificial sequence
  primer oBP601
tcataccacaatcttagaccat

SEQ ID NO: 149 - DNA, 21 bp, Artificial sequence
  primer oBP602
tgttcaaacccctaaccaacc

SEQ ID NO: 150 - DNA, 22 bp, Artificial sequence
  primer oBP603
tgttcccacaatctattaccta

SEQ ID NO: 151 - DNA, 21 bp, Artificial sequence
  primer oBP604
tactgaacagggactccgcga

SEQ ID NO: 152 - DNA, 21 bp, Artificial sequence
  primer oBP606
tcataccacaatcttagacca

SEQ ID NO: 153 - DNA, 34 bp, Artificial sequence
  primer oBP562
aattgtttaaacatgtatacagtaggtgactatc

SEQ ID NO: 154 - DNA, 49 bp, Artificial sequence
  primer oBP563
aatcataaatcataagaaattcgcttatcagctcttgttttgttctgca

SEQ ID NO: 155 - DNA, 49 bp, Artificial sequence
  primer oBP564
ttatttgcagaacaaaacaagagctgataagcgaatttcttatgattta

SEQ ID NO: 156 - DNA, 34 bp, Artificial sequence
  primer oBP565
aattggccggccaaaaaaagcatgcacgtataca

SEQ ID NO: 157 - DNA, 32 bp, Artificial sequence
  primer oBP505
aattgagctcactgtagccctagacttgatag

SEQ ID NO: 158 - DNA, 35 bp, Artificial sequence
  primer oBP506
aattggcgcgcctgtatatgagatagttgattgta

SEQ ID NO: 159 - DNA, 35 bp, Artificial sequence
  primer oBP507
aattttaattaagtctaggttctttggctgttcaa

SEQ ID NO: 160 - DNA, 33 bp, Artificial sequence
  primer oBP508
aattgtcgactttagaagtgtcaacaacgtatc

SEQ ID NO: 161 - DNA, 8366 bp, Artificial sequence
  Synthetic construct-pRS316-UAS(PGK1)-pFBA2-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 162 - DNA, 34 bp, Artificial sequence
  primer oBP674
aattggcgcgccaattaccgtcgctcgtgatttg

SEQ ID NO: 163 - DNA, 34 bp, Artificial sequence
  primer oBP675
aattgtttaaacttgaatatgtattacttggtta

SEQ ID NO: 164 - DNA, 22 bp, Artificial sequence
  primer oBP495
ggagatatacaatagaacagat

SEQ ID NO: 165 - DNA, 22 bp, Artificial sequence
  primer oBP496
tagcaatggggtttttttcagt

SEQ ID NO: 166 - DNA, 12896 bp, Artificial sequence
  Synthetic construct-pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 167 - DNA, 11017 bp, Artificial sequence
  Synthetic construct-pRS426::GPD-xpk1+ADH-eutD
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 168 - DNA, 62 bp, Artificial sequence
  primer N1176
gcatagcaatctaatctaagttccagctgaggatgacaacagattactcatcaccagcatat

SEQ ID NO: 169 - DNA, 62 bp, Artificial sequence
  primer N1177
atcaacacacaaacactaaatcaaagctgaggatggatttatttgagtcattagcacaaaaa

SEQ ID NO: 170 - DNA, 44 bp, Artificial sequence
  primer N822
cgcctcagctttgatttagtgtttgtgtgttgataagcagttgc

SEQ ID NO: 171 - DNA, 63 bp, Artificial sequence
  primer N1178
ggtatcgataagcttgatatcgaattcctgcgcccgggccactagtcagatgccgcgggcact

SEQ ID NO: 172 - DNA, 10934 bp, Artificial sequence
  Synthetic construct-pRS423::TEF(M4)-xpk1+ENO1-eutD
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 173 - DNA, 38 bp, Artificial sequence
  primer N821
cgcccgggccactagtcagatgccgcgggcacttgagc

SEQ ID NO: 174 - DNA, 30 bp, Artificial sequence
  primer N1115
tttttgtgctaatgactcaaataaatccat

SEQ ID NO: 175 - DNA, 30 bp, Artificial sequence
  primer N1110
gcgatttaatctctaattattagttaaagt

SEQ ID NO: 176 - DNA, 30 bp, Artificial sequence
  primer N1114
atatgctggtgatgagtaatctgttgtcat

SEQ ID NO: 177 - DNA, 22 bp, Artificial sequence
  primer N160SeqF5
cctgaagtctaggtccctattt

SEQ ID NO: 178 - DNA, 38 bp, Artificial sequence; identical to SEQ ID NO: 75
  primer BK468

SEQ ID NO: 179 - DNA, 9220 bp, Artificial sequence
  Synthetic construct-pUC19-URA3::pdc1::TEF(M4)-xpk1::kan
ccgcattgcggattacgtattctaatgttcagataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatccagtgatgatacaacgagttagccaaggtgggggatcctctagagtcttaaggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttttatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaa

SEQ ID NO: 180 - DNA, 20 bp, Artificial sequence
  primer N886
caatgattgttggtaaaggg

SEQ ID NO: 181 - DNA, 30 bp, Artificial sequence
  primer N1214
aaaaagggggtagaagcgttttgaagctat

SEQ ID NO: 182 - DNA, 9593 bp, Artificial sequence
  Synthetic construct-pYZ090DalsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 183 - DNA, 19 bp, Artificial sequence
  primer N160SeqR5
tgagcccgaaagagaggat

SEQ ID NO: 184 - DNA, 32 bp, Artificial sequence
  primer oBP622
aattggtaccccaaaaggaatattgggtcaga

SEQ ID NO: 185 - DNA, 49 bp, Artificial sequence
  primer oBP623
ccattgtttaaacggcgcgccggatcctttgcgaaaccctatgctctgt

SEQ ID NO: 186 - DNA, 49 bp, Artificial sequence
  primer oBP624
gcaaaggatccggcgcgccgtttaaacaatggaaggtcgggatgagcat

SEQ ID NO: 187 - DNA, 34 bp, Artificial sequence
  primer oBP625
aattggccggcctacgtaacattctgtcaaccaa

SEQ ID NO: 188 - DNA, 34 bp, Artificial sequence
  primer oBP626
aattgcggccgcttcatatatgacgtaataaaat

SEQ ID NO: 189 - DNA, 34 bp, Artificial sequence
  primer oBP627
aattttaattaattttttttcttggaatcagtac

SEQ ID NO: 190 - DNA, 40 bp, Artificial sequence
  primer HY21
ttaaggcgcgcctatttgtaatacgtatacgaattccttc

SEQ ID NO: 191 - DNA, 56 bp, Artificial sequence
  primer HY24
acttaataactttaccggctgttgacattttgttcttcttgttattgtattgtgtt

SEQ ID NO: 192 - DNA, 56 bp, Artificial sequence
  primer HY25
aacacaatacaataacaagaagaacaaaatgtcaacagccggtaaagttattaagt

SEQ ID NO: 193 - DNA, 40 bp, Artificial sequence
  primer HY4
ggaagtttaaacaccacaggtgttgtcctctgaggacata

SEQ ID NO: 194 - DNA, 30 bp, Artificial sequence
  primer URA3-endF
gcatatttgagaagatgcggccagcaaaac

SEQ ID NO: 195 - DNA, 22 bp, Artificial sequence
  primer oBP637
tttttgcacagttaaactaccc

SEQ ID NO: 196 - DNA, 22 bp, Artificial sequence
  primer oBP636
catttttttccctctaagaagc

SEQ ID NO: 197 - DNA, 34 bp, Artificial sequence
  primer oBP695
aattgcggccgcatgacaggtgaaagaattgaaa

SEQ ID NO: 198 - DNA, 34 bp, Artificial sequence
  primer oBP696
aattttaattaaacgggcatcttatagtgtcgtt

SEQ ID NO: 199 - DNA, 34 bp, Artificial sequence
  primer oBP693
aattgtttaaacaaaggatgatattgttctatta

SEQ ID NO: 200 - DNA, 33 bp, Artificial sequence
  primer oBP694
aattggccggccgcaacgacgacaatgccaaac

SEQ ID NO: 201 - DNA, 40 bp, Artificial sequence
  primer oBP691
aattggatccgcgatcgcgacgttctctccgttgttcaaa

SEQ ID NO: 202 - DNA, 41 bp, Artificial sequence
  primer oBP692
aattggcgcgccatttaaatatatatgtatatatataacac

SEQ ID NO: 203 - DNA, 40 bp, Artificial sequence
  primer HY16
ttaaggcgcgccccgcacgccgaaatgcatgcaagtaacc

SEQ ID NO: 204 - DNA, 56 bp, Artificial sequence
  primer HY19
acttaataactttaccggctgttgacattttgattgatttgactgtgttattttgc

SEQ ID NO: 205 - DNA, 56 bp, Artificial sequence
  primer HY20
gcaaaataacacagtcaaatcaatcaaaatgtcaacagccggtaaagttattaagt

SEQ ID NO: 206 - DNA, 22 bp, Artificial sequence
  primer oBP731
tgttcccacaatctattaccta

SEQ ID NO: 207 - DNA, 34 bp, Artificial sequence
  primer HY31
gccgactttatggcgaagaagtttgctcttgatc

SEQ ID NO: 208 - DNA, 22 bp, Artificial sequence
  primer oBP730
ttgctccaaagagatgtcttta

SEQ ID NO: 209 - DNA, 725 bp, Artificial sequence
  Synthetic construct-UAS(PGK1)-PFBA1
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 210 - DNA, 36 bp, Artificial sequence
  primer oBP821
aattgtttaaactaagcgaatttcttatgatttatg

SEQ ID NO: 211 - DNA, 34 bp, Artificial sequence; identical to SEQ ID NO: 156
  primer oBP484

SEQ ID NO: 212 - DNA, 37 bp, Artificial sequence
  primer oBP822
aattgcggccgcgtgcctcatctatatttctgaaatc

SEQ ID NO: 213 - DNA, 37 bp, Artificial sequence
  primer oBP823
aattttaattaatcagctcttgttttgttctgcaaat

SEQ ID NO: 214 - DNA, 1647 bp, Artificial sequence
  Listeria grayi sequence codon optimized for S. cerevisiae
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 215 - DNA, 36 bp, Artificial sequence
  primer oBP828
aattgtttaaacatgtataccgtaggacagtacttg

SEQ ID NO: 216 - DNA, 35 bp, Artificial sequence
  primer oBP829
aattgtttaaacttaagagttttgcttagataagg

SEQ ID NO: 217 - DNA, 29 bp, Artificial sequence
  primer FBAp-F
ctacaatcaacagatcgcttcaattacgc

SEQ ID NO: 218 - DNA, 9612 bp, Artificial sequence
  Synthetic construct-pLH702
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgatattttcctctggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 219 - DNA, 7938 bp, Artificial sequence
  Synthetic construct-pYZ067DkivDDhADH
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 220 - DNA, 60 bp, Artificial sequence
  primer oBP830
tatttaataataaaaatcataaatcataagaaattcgcttaagagttttgcttagataag

SEQ ID NO: 221 - DNA, 29 bp, Artificial sequence
  primer HY51
ggagatatacaatagaacagataccagac

SEQ ID NO: 222 - DNA, 25 bp, Artificial sequence
  primer oBP906
ttgtcaacggataagattgtagttg

SEQ ID NO: 223 - DNA, 29 bp, Artificial sequence
  primer HY50
gagagttcactgtttaacaatagcaatgg

SEQ ID NO: 224 - DNA, 1641 bp, Artificial sequence
  Macrococcus caseolyticus sequence codon optimized for S. cerevisiae
atgaaacaacgtatcgggcaatacttgatcgatgccctacacgttaatggtgtcgataagatctttggagtcccaggtgatttcactttagcctttttggacgatatcataagacatgacaacgtggaatgggtgggaaatactaatgagttgaacgccgcttacgccgctgatggttacgctagagttaatggattagccgctgtatctaccacttttggggttggcgagttatctgctgtgaatggtattgctggaagttacgcagagcgtgttcctgtaatcaaaatctcaggcggtccttcatcagttgctcaacaagagggtagatatgtccaccattcattgggtgaaggaatctttgattcatattcaaagatgtacgctcacataaccgcaacaactacaatcttatccgttgacaacgcagtcgacgaaattgatagagttattcattgtgctttgaaggaaaagaggccagtgcatattcatttgcctattgacgtagccttaactgagattgaaatccctcatgcaccaaaagtttacacacacgaatcccagaacgtcgatgcttacattcaagctgttgagaaaaagttaatgtctgcaaaacaaccagtaatcatagcaggtcatgaaatcaattcattcaagttgcacgaacaactggaacagtttgtcaatcagacaaacatccctgttgcacaactttccttgggtaagtctgctttcaatgaagagaatgaacattaccttggtatctacgatggcaaaatcgcaaaggaaaatgtgagagagtacgtcgacaatgctgatgtcatattgaacataggtgccaaactgactgattctgctacagctggattttcctacaagttcgatacaaacaacataatctacattaaccataatgacttcaaagctgaagatgtgatttctgataatgtttcactgattgatcttgtgaatggcctgaattctattgactatagaaatgaaacacactacccatcttatcaaagatctgatatgaaatacgaattgaatgacgcaccacttacacaatctaactatttcaaaatgatgaacgcttttctagaaaaagatgacatcctactagctgaacaaggtacatcctttttcggcgcatatgacttatccctatacaagggaaatcagtttatcggtcagcctttatgggggtcaatagggtatacttttccatctttactaggaagtcaactagcagacatgcataggagaaacattttgcttataggcgatggtagtttacaacttactgttcaagccctaagtacaatgattagaaaggatatcaaaccaatcattttcgttatcaataacgacggttacaccgtcgaaagacttatccacggcatggaagagccatacaatgatatccaaatgtggaactacaagcaattgccagaagtatttggtggaaaagatactgtaaaagttcatgatgctaaaacctccaacgaactgaaaactgtaatggattctgttaaagcagacaaagatcacatgcatttcattgaagtgcatatggcagtagaggacgccccaaagaagttgattgatatagctaaagcctttagtgatgctaacaagtaa

SEQ ID NO: 225 - DNA, 7589 bp, Artificial sequence
  Synthetic construct-pUC19-kan::pdc1::FBA-alsS::TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 226 - DNA, 36 bp, Artificial sequence
  primer oBP900
aattgtttaaacatgaaacaacgtatcgggcaatac

SEQ ID NO: 227 - DNA, 37 bp, Artificial sequence
  primer oBP901
aattgtttaaacttacttgttagcatcactaaaggct

SEQ ID NO: 228 - DNA, 719 bp, Artificial sequence
  UAS(PGK1)-FBA1
aattaccgtcgctcgtgatttgtttgcaaaaagaacaaaactgaaaaaacccagacacgctcgacttcctgtcttcctattgattgcagcttccaatttcgtcacacaacaaggtcctgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 229 - DNA, 636 bp, Artificial sequence
  Promoter UAS(PGK1)-ENO2
aattaccgtcgctcgtgatttgtttgcaaaaagaacaaaactgaaaaaacccagacacgctcgacttcctgtcttcctattgattgcagcttccaatttcgtcacacaacaaggtcctgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 230 - DNA, 979 bp, Artificial sequence
  Promoter UAS(FBA1)-PDC1
tgacagcaggattatcgtaatacgtaatagttgaaaatctcaaaaatgtgtgggtcattacgtaaataatgataggaatgggattcttctatttttcctttttccattctcgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 231 - DNA, 994 bp, Artificial sequence
  UAS(PGK1)-PDC1
aattaccgtcgctcgtgatttgtttgcaaaaagaacaaaactgaaaaaacccagacacgctcgacttcctgtcttcctattgattgcagcttccaatttcgtcacacaacaaggtcctgtcgacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 232 - DNA, 731 bp, Artificial sequence
  UAS(PGK1)-OLE1
aattaccgtcgctcgtgatttgtttgcaaaaagaacaaaactgaaaaaacccagacacgctcgacttcctgtcttcctattgattgcagcttccaatttcgtcacacaacaaggtcctgtcgaccggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaa

SEQ ID NO: 233 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 234 - protein, 343 aa, Artificial sequence
  Anaerostipes caccae KARI variant K9D3
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 235 - protein, 343 aa, Artificial sequence
  Anaerostipes caccae KARI variant K9G9
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 236 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 237 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 238 - protein, 690 aa, Saccharomyces cerevisiae
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 239 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 240 - protein, 416 aa, Saccharomyces cerevisiae
MKAKSMKSIISVPISVSKTGKMKLTASPDNLASMMSKDQNKLIHLDPVPSFEDRHEIKPWLQKIFYPQGIDIVIERSDSSKVTFKCRSVRSKVGLNPKSKGSSSRSHACPFRIRAAYSVRLQKWNVVVMNNIHSHELRFDLITKTDDYKKFKENLRQKNDEKAIKTFDELEYKASLNLPLVTPIISCDCGLTKEIEAFNNIFLPLSNPPLTSKKNLLKTNKNSVSKIKSRQMDNSKPRPRLKTKLDADLHDTGFLDNFKTRNSCVKIEKEDSLTNLNEIDFTNMFCNDNFIQNYNQGLMELLTEPTPGPSSSSCILPSTPTRPLSQSKMDIALSESTTSSPNFMETDAPYGDEIIKVSKDTKSNAPTADTDIATNLGKERNENFGMLNYNYEALLHFNDEHFNELNSIDPALISKY

SEQ ID NO: 241 - DNA, 363 bp, Saccharomyces cerevisiae
atgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatga

SEQ ID NO: 242 - protein, 120 aa, Saccharomyces cerevisiae
MTGERIEKVKINDEFAKSHFLTTQWRETKRQRHYKMPVTEQGLRERIESAIPQVYHIIVTDLSYGCGQSFDIVVVSDFFQGKSKLMRSRAVNKAVKEELQEIHAFSCKCYTEEEWSKIVV

SEQ ID NO: 243 - DNA, 858 bp, Saccharomyces cerevisiae
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 244 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 245 - DNA, 969 bp, Saccharomyces cerevisiae
atgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaa

SEQ ID NO: 246 - protein, 322 aa, Saccharomyces cerevisiae
MSIVALKNAVVTLIQKAKGSGGTSELGGSESTPLLRGSNSNSSRHDNLSSSSSDIIYGRNSAQDLENSPMSVGKDNRNGDNGSDNEKANLGFFQSVDPRVISDLIIGLSDGLTVPFALTAGLSSLGDAKLVITGGFAELISGAISMGLGGYLGAKSESDYYHAEVKKEKRKFYDNSNLINREIEDILLEINPNFSDETIVSFIKDLQRTPELMVDFIIRYGRGLDEPAENRELISAVTIGGGYLLGGLVPLVPYFFVSDVGTGLIYSIIVMVVTLFWFGYVKTKLSMGSGSSTSKKVTEGVEMVVVGGVAAGAAWFFVKLLG

SEQ ID NO: 247 - protein, 347 aa, Beijerinkia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 248 - DNA, 47 bp, Artificial sequence
  upper primer
catcatcacagtttaaacagtatgttgaagcaaatcaacttcggtgg

SEQ ID NO: 249 - DNA, 48 bp, Artificial sequence
  lower primer
ggacgggccctgcaggccttattggttttctggtctcaactttctgac

SEQ ID NO: 250 - DNA, 52 bp, Artificial sequence
  primer OT1349
catcatcacagtttaaacagtatgaaagttttctacgataaagactgcgacc

SEQ ID NO: 251 - DNA, 51 bp, Artificial sequence
  Primer OT1318
gcacttgataggcctgcagggccttagttcttggctttgtcgacgattttg

SEQ ID NO: 252 - DNA, 15 bp, Artificial sequence
  Primer OT1383
ctagtcaccggtggc

SEQ ID NO: 253 - DNA, 15 bp, Artificial sequence
  Primer OT1384
ggccgccaccggtga

SEQ ID NO: 254 - DNA, 13114 bp, Artificial sequence
  pYZ067
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgccgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacatgtttaaactttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 255 - DNA, 7938 bp, Artificial sequence; identical to SEQ ID NO: 219
  pYZ067dkivDdhADH

SEQ ID NO: 256 - protein, 583 aa, Ralstonia eutropha H16
MRMQIGTFLARRLKEAGVRHVFGVPGDFNLSFLEQIHDARGIEFVGNCNELNAAYAADGYARTSGLAAFVTTFGVGDLAAIGGIAGAYAENVPVVHITGAPPLHAVNSGALVHHTLVDGDYENIGRCMSEFTVAQARITPANAAYEIDRVLRSCWLERRPVHLQLPSDVTHIVVEVPDAPLLLADPASDPRQLRVAVQRIVEALDAARAPVLLVDADADRFGVTDLIVKIAEKCAIPCASLMPAKGAIDETCSHYIGSYAGAASAASVRHVVENTDCLIGVGLRFTDSSTALFSQRINMESFIDLRRHDLSIGTTQMPGVTLRDVLAGVHESAKSNSRPLAGELSAPANLTDPAPVSDDAPLTHATLWPRVRRFLQPGDVIVGEAGTAHAGLVSMSLPAGASYIAAPTWGAVGFSLPALFGSHVGASSRRHLLFIGDGSFQFTAQELSSILRRGLKPVIFLLNNGGYTIERMILGENSAYNDVDNWRYTDLARAFDRHDRSLSIEVRTVGELDVALGRAESADCLVFVELNLPKMDAPALLKQFACHLANFDYGECGPRNSAPDLTQGAKAPAHRAHGERVGA

SEQ ID NO: 257 - protein, 552 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQAHADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELCKQHVHAGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEACNNA

SEQ ID NO: 258 - protein, 555 aa, Mycobacterium smegmatis str. MC2 155
MTDDGYTVGDYLLDRLAELGVTEVFGVPGDYQLEFLDHVVAHPRITWVGGANELNAGYAADGYGRLRGMAALVTTFGVGELSAANAIAGSYAEHVPVVHIVGAPSKDSQAARRIVHHTLGDGDFEHFLRMSREITCAQANLVPATATREIDRVLSEVHEQKRPGYLLIATDVARFPTEPPTAPLPRHSGGTSPRALSLFTEAATQLIGEHRLTVLADFLVHRMGCVEALNKLLTADTVPHATLMWGKSLVDESSPNFLGIYAGAASEGSVREVIEDAPVLVTAGVLFTDMVSGFFSQRIDPARTIDIGVNQSVVAGQVFAPLDMAAALDALASILAERGIESPALPPAPAPQRPAAPPRDAVLTQEALWDRLAEALTPGNVVLADQGTSFYGLAGHRLASGVTFIGQPLWASIGYTLPAALGAGLADRDRRTVLLIGDGAAQLTVQELGAFGREGLTPVVVVVNNNGYTVERAIHGVTARYNDITAWRWTELPAALGVPDALTFRCATYGELDDALTVAAETQDRMVFVEVMLERMDIPPLLGELAQSASAANAK

SEQ ID NO: 259 - protein, 566 aa, Mycobacterium ulcerans Agy99
MTLLENDAATDPVYTVGDYLLDRLAELGVSEIFGVPGDYNLEFLDHIVAHPIIRWVGSANELNAGYAADGYGRLRGMSAVVTTFGVGELSATNAIAGSYAEHVPVVHIVGGPSKDAQGARRALHHSLGDGDFEHFFRISREITCAQANLMPATACREIDRVICEVREQKRPGYLLLSTDVARFPTEPPGAPLPPLAGGTSPRALSLFTRAAADLIGDHQLTVLADLLVHRLQAIKELEALLSADVVPHATLMWGKSLLDESSANFLGIYAGAASAEPVRKAIEQAPVLVTAGVVFTDMVSGFFSQRIDPARTIDIGQYQSSVADQVFAPLEMGAALQAVATILTKRGISSPPVAVPPAEPGPPTPRRDEPLNQEMLWNRLCEALTPGNVVLADQGTSFYGMADHRLPQGVTFIGQPLWGSIGYTLPAALGAAVAHPDRRTVLLIGDGAAQLTVQELGIFSREGLSPVIVVVNNDGYTVERAIHGETATYNDIVSWRWTDVPGALGVTNHLAMRAENYGELDDALTAAAEQQDRMVVVEAVLPRLDVPPLLDELVGSLSPPECGGRS

SEQ ID NO: 260 - protein, 554 aa, Yersinia enterocolitica subsp. enterocolitica 8081
MMASNYKVADYLLDRLAQVGIRHLFGVPGDFNLHFLDHVISHPVIQWMGCANELNAAYAADGYARVMPAAALLTTAGVGELSAINGIAGSFAEYLPIIHIVGTPALRSQKAGELLHHSFGDGDFNHFARMAKEVACAHTSLTAENAASEIDRLLVAALYQRRPVYLQLPSDVGEAELTSQSGALALSQPMLSPTSLQAFIEAARQKLQSAHRVALLADFLADRFGARQALNHWLAEVNLPHSTLLMGKGLLDETHPMFIGTYAGAASDASVREYIEEADVLITVGVWFVDTITAGFSQHITQDNCIDVQPEQVRIGRQVFSQIPMLAAVNALHELCLSLQGEWQQPVIAHSMPALPSDNLLSQQAFWYHIQHFLRPDDIVVTDQGTSSFGAATLRLPSGCTFVAQSLWGSIGFSLPAAYGAQLAQPQRRVILLVGDGAAQLTIQELGSMLRDGLTPIIFLLNNHGYTVERAIHGPQQPYNDIAEWDWTQLPQALAVDKASLTCRVTQADELQQVLTQIENCQQLAFIEVMLPPMDMPELMVNVAKSIQARNAAV

SEQ ID NO: 261 - protein, 505 aa, Acinetobacter baumannii ATCC 17978
MATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPLLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPVKCKDAISF

SEQ ID NO: 262 - protein, 583 aa, Leishmania infantum JPCM5
MPFNGYTVGCHLLDRLVEAGCDHLFGVPGDFNLRFLDDVMAHPRMKWVGTANELNAAYAADGYARQRGLGAVTTTYGVGELSALNGIAGSFAESVPVIHIAGATSTKSQGNRELLHHSLGDGSHMHFLNISAEVCCIAVMLTPENCLTEIDRVITEVLYQKKPGYIALPMNVAEMIVPPPPAKLMRRLPEVSLESVSAFKHTVASRLHSARSPAVLTGHLIHRHQCGPQVNHFLENVHIPYAPAVLGKGAVNEHLENYVGTYIAGDEPCPAKSVIESADVCISIGVQFVDTVTSIFRHKIDPLKMIDIQPFFAKVGDQVFYQVPMEMAVKAVEEVAMECHTNWSTEYPEPEGLRYPESPDTFDLSHVWQEISNGLQPNDVLLVDIGTSSFTSALLRLPQGCDMLCQQMWASIGYTLPAAIGAQIADESRSVVCVLGDGAAQMTVQELGSAARYKLKPKYILINNDGYTIERYIRGWDSSYNDISVWNWTGLARNFCKGVEPRTCVVNSVGGVEAVLREKQDNMVFVEVLVGKYEGPLRSSVPLPRKPASKEREALDFQRRESKSEGSGVDAETMMMASKTLLT

SEQ ID NO: 263 - protein, 552 aa, Enterobacter sp. 638
MRTPYCVADYLLDRLSQCGVEHLFGVPGDYNLQFLDHVIDSPEIRWVGCANELNASYAADGYARCQGFAALLTTFGVGELSAMNGIAGSFAEYVPVLHIVGAPCSAAQQKGELMHHTLGDGEFRHFFKMSESITAAQAILTEQNACYEIDRVLSVMRRERRPGYLMLPADVAKKPAIPPVSAFTNALFPFDNACLQAFREAAEARLATSHRTALLADFLVLRYGLKNPLQAWVKETPMAHATMLMGKGIFDERQAGFYGTYSGAASTDAVRDAIEGADTVICVGTRFTDTLTAGFTHKLTAAQTIEVQPHAARIGDRWFTGIPIARAVEILSELCRQHVTQHDLPIHKPALSQEYHQGKLTQDNFWHTLQTFIRPGDIILADQGTAAFGASALRLPSDVNFIVQPLWGSIGFTLAAAFGAQTACPDRRVIVLTGDGAAQLTIQEIGSMLRDDQRPVILVLNNEGYTVERAIHGAEQRYNDIALWNWTQIPQALSLNCQAQCWRVSETVQLAEVLEKVAHRERLSLIEVMLPKEDIPSLLSAITKALEARNSG

SEQ ID NO: 264 - protein, 546 aa, Staphylococcus aureus subsp. aureus JH9
MKQRIGAYLIDAFHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTATKDTDASTYIELLATKLHQAKQPIIITGHEINSFHLHQELEDFVNQTQVPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNSATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 265 - protein, 553 aa, Psychrobacter sp. PRwf-1
MSQPIYTIADYLFDRVAEAGATEIFGVPGDYNLAFLDNIIASNKLRWVGNTNELNAGYAADGYARERRFSAMVTTFGVGELSAINATAGSYAEYVPVLHIVGAPNTQLRDGKRRLHHSLGDGVFNHFIKMVEPVSVARSEITAENAASEIDRVIRMVLKKQRPGYLLLSPDVAKLPIYRPTTQLKDSEEDITSQEALADFKKELSCYIEGKATTLIADLMVHRLGLQSQLKALIADTQIPYATLSWGKTLLDEHSDRWAGVYVGEPSQPTVKDAIENAECLIKLGVNYTDTTTSGFTQKIDTSKVVDIHQERATVADKTFAPIAMKDALKALHEVLTSGIEVVAKPLIAPVDVHQQQGGDDEPLLQKDLWHIVADCLDGNNLVFAEQGTAYFGMSEVRLPEGVTFYGQPLWGSIGYTLPASLGAGIASPNKRSVLLIGDGSALLTIQDLAVMIREQLNPVILLINNAGYTVERAIHGEEELYNDIPVCDWQVMPQAFGANQHNCLTLKAATPAELKSALSQADKAKDKMVFIEVITGMMDIPPLLQDVAASLK

SEQ ID NO: 266 - protein, 554 aa, Clostridium acetobutylicum ATCC 824; identical to SEQ ID NO: 60

SEQ ID NO: 267 - protein, 550 aa, Pantoea agglomerans
MSTFTVGDYLLTRLQEIGIKHLFGVPGDYNLQFLDRVIAHPEISWVGCANELNAAYAADGYARCNGAGALLTTFGVGELSAINGTAGSYAEYLPVIHIVGAPATQAQLQGDCVHHSLGDGDFQHFIRMAAEVSVATALLTADNATAEIDRVIISALQARRPGYLSLAVDVAAMAVQPPAQPLNTHQPASADARRAFRAAAERLLAPAQRVSLLADFLALRWQQQSALAALREQSAIPCASLLMGKGVLDEQQPGYVGTYAGAASAGQVCEQIEQVDAAICVGVRFTDTITAGFTQQFATERLIDLQPFSASVGNERFAPLSMADALSELQPLFEHYGQQWQPAAAIPAAQPAEPTAVISQHAFWQAMQGFLQPGDLILAEQGTAAFGAAALRLPSRAQLVVQPLWGSIGYTLPAAFGAQTANPDRRVILIIGDGSAQLTIQELGSMLRDGQRLIIFLLNNDGYTVERAIHGATQRYNDIAPWNWTALPHALSLQGQAQSWRISETVQLDEVMTRLAAPQWLSLVEVVMLKDDLPPLLRKVTACLNQRNGG

SEQ ID NO: 268 - protein, 555 aa, Klebsiella pneumoniae subsp. pneumoniae MGH 78578
MDMQPTYTIGDYLLDRLVDCGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFCEHASRLLRSSRRISLLADFLAQRYGLQKTLREWVAKTPVAHATMLMGKGLFDEQQSGFVGTYSGIASAPQTREAIENADTIICIGTRFTDTITAGFTQHLAREKTIEIQPFAVRVGDHWFSGVPMDKALAALMTLSAPLAAEWATPQVVAPEAEEGAEGELTQKNFWATVQGALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVASRCRRVTQTSELREAMTESITSDTLTLVEVMLPKMDIPDFLRAVTQALEERNSRV

SEQ ID NO: 269 - protein, 550 aa, Leishmania braziliensis MHOM/BR/75/M2904
MPFNGYTVSCYLLDRLVEAGCEHLFGVPGDFNLRFLDDVMTNPRMKWIGTANELNAAYAADGYARQRGLGAVATTCGVGELSALNGIGGSFAESVPVIHIAGAPSTKSQGNRELLHHTLGDGNHAHFLHISAEVCCIAVMLTPENCLMEIDRVITEVLYQKKPGYIALPTNLAEMIVPPPPTKLMRRLPEVSPDSVSAFKLTVASHLHSSCNPAVLTGHLIQRYQCGPFVNRFLENVRIPYAAAVLGKGAVNEHLENYVGTYIAGNAPCPAKSVIENADVCISIGVQFVDTVTAVFRHKIDPLKLIDIQPFFAKVGDQIFPQVPMEVAVKVVEETAMECHTNWSTEYPDPDSFRSPDSADTLDLCHVWREIQNGLRPNDVLLVELGTSSFTSALLRLPQGCDMLCQQMWASIGYTLPAAIGAQLADENRRVVCIIGDGAAQMTVQELGTAARYRLKPTYILVNNDGYTIERFIRGWDSSYNDVAVWNWTGLARNFCKGVEPRTCLVNSVGGVEAVLRESQDNMVFAEVLVGKFEGPLCTSVELPGKPTSK

SEQ ID NO: 270 - protein, 560 aa, Mycobacterium tuberculosis H37Rv
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTDMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 271 - protein, 504 aa, Nasonia vitripennis
MKKSYTVADYLLDRLAQIGIHHLFGVPGDYNLQFLDHVISHPQIDWIGCANELNASYAADGYARCKPASAMLTTFGVGELSAINGIAGAYAEYLPIIHIIGAPVLQFQRDGLLLHHSLGDGDFEHFSRMAKEVSVAQACLTPSNAESEIDRLITIALSEHRPVHLVIPCDVAILPLVSKPAPLVLPTSVLSNTSLKMFIESARKKLTGTKKVSVLAGCLAERLNVQPLLQQWMDEVALPHSALLFGKGVFNENHSNYAGTYIGAASEAEIKNLIENVDVTINIGVLFIDTATAGFSHKLPTENCISIHPNEARVGHQVFTQIPMEDAIKALHQLTLSLAQQWPLPIINPPSLSPPLSQTSKSKLDQRSFWREIQKFIRPNDILFTDQGTSCFGAAELILPENCKFVIQSLWASVGFSLAATFGAQLAEPNRRVILLIGDGAAQFTVQELGTMLRNGLKPIIFLMNNQGYTVERAIHGPEQVYNDITAWDWTLLFKAFANQYPAF

SEQ ID NO: 272 - protein, 457 aa, Lactococcus lactis subsp. lactis Il1403
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLEKTVTQFISKTKLPITTLNFGKSSVDETLPSFLGIYNGKLSEPNLKEFVESADFILMLGVKLTDSSTGAFTHHLNENKMISLNINEGKIFNERIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQERKLQVQVSQPSSSHMNSYS

SEQ ID NO: 273 - protein, 558 aa, Cronobacter sakazakii ATCC BAA-894
MAKMPAHYCIADYLLDRLAGCGVKHLFGVPGDYNLLFLDNVIAHPRITWVGCANELNGAYAADGYARCNGIGALLTTYGVGELSALNAIAGSYAEAVPVLHIVGAPCQSAQRKGEVLHHTLGDGDFHHFMRIAREVTAAQGWLTPANACSEIDRVIAEMLRTRRPGYLVLPTDVASAPAVAPVNAITVPRPQGDDAQLAAFREAAQARFASAGRVALLADFLAQRFGVQNALHQWLDDTPMPHSSLLMGKGVLDETKPGFTGTYSGAASDPAVCQAIEEADLVICVGVQFADTITAGFTQRLTRDQTIDIQPWATRVGDRWFSGIAMDQAVAILHDIARRHSARLPPPDVAPPVAKPTTAGALNQQNFWPLIETFLQPGDIIAVDQGTAAFGAAALRLPAGCDFLVQPLWGSIGYALPAAFGAQTACPNRRVVLITGDGAAQLSIQEMGSMLRDGQAPVVIVLNNDGYTVERAIHGATQRYNDIAPWQWTKLPHALHADSQAQSWRVSDAAQLKEVLERLSRPERLSLIEVMLPRDDVPPLLDAVSRALEARNGAQDE

SEQ ID NO: 274 - protein, 551 aa, Citrobacter koseri ATCC BAA-895
MQTPYSVADYLLDRLAGCGIGHLFGVPGDYNLQFLDHVIAHRDVCWVGCANELNAAYAADGYARLAGAGALLTTFGVGELSALNGLAGSYAEYVPVLHIVGAPCSGAQRRGELMHHTLGDGDFQHFYRISQAVTAASAVLNEQNACYEIDRVLRGMLTMRRPGYLMLPADVAKRPAVPPVNVLTPDRAEGENDTVAAFRYRARQRLMNSPRVALLADFLALRFGLQPVLQRWMAETPIAHATLLMGKGLFDEQHPNFVGTYSAGASSESVRQAIEEADTVICVGTRFVDTLTAGFTQQLPQERTIEIQPHASRVGNSWFSGLSMEQAVTTLRELCLELSFSPPPTPAHAPGGHIEKGTLTQENFWHTVQAYLLPGDIILADQGTAAFGAADLSLPAGADVLVQPLWGSIGYALPAAFGAQTACPERRVILITGDGAAQLTIQELGSMMRDGQSPVILLLNNDGYTVERAIHGANQRYNDIAGWNWTQVPQALSANCQAECWRVTQAIQLEEVLARLKSPQRLSLIEVVLPKADLPELLRTVTRALESRNGE

SEQ ID NO: 275 - protein, 558 aa, Serratia proteamaculans 568
MKITIGAFILQQLRTLNIDRIYGVPGDYNLALLELIEQDDKLEFIGNCNELNASYAADGYARLKGAGALITTYGVGDLAALSGIAGAYAESAPVVCLSGTPPLHAMKNHLLLHHTLADGNFDNVMNCFKQFTVAQALITPENAAVEIPRVISRAWTEKKPVYLQLPSDICDVEIEITQAVAPPQLPASDKYNVQLAAMALLARLKLAKKPIILVDQMVDRFQLQQLVIDVAHKFAIPLTNMPTAKCIIPETTPGWIGGYSGNLSRPELYEHMAHSDCVLSFGVRLVDSTTGYFSHRIPSDAQIDIQPFSVKLGETSYPAVATADLLQALLALGEGVADHQPAVLPEARHRLATPSETPIDQAYLWQRLQRFIRADDVLVVENGTSGAAIGGMRMPDGVQVVNQPIWGSIGYTLPALLGTMMAAPERRHLLFIGDGSFQLTAQEVSTLLRYDQKPIIFLINNDGYTIERYILGENSSYNDIGPWDYAKLPAVLNTQATPFCVAVETTQQLELALEHASRQDQLTFIEIKVPMMDTPPVMKEFCNRCNNFNFGLTNPRRA

SEQ ID NO: 276 - protein, 553 aa, Serratia proteamaculans 568
MNTTYRVADYLLDRLAQIGIRHFFGVPGDYNLQFLDHVISHPQITWVGCANELNAAYAADGYARCKPAAALLTTFGVGELSALNGIAGSYAEYLPVIHVVGAPTLRAQRAGDLLHHSLGDGDFGHFARMAKEVTVAQASLTPDNAEAEIDRLLTIALFEHRPVYIVLPSEVAEAPLASRPAPLVLRQAHLSQASLQAFIAAARQMLLPARRVSLLADFLAERFGAEKVLEQWMNEVEIPHSTMLLGKSVLDETHACFTGTYAGAASDPQVKQLIEGADVVINVGVRFTDTITAGFSHHLPAEKCIDLQPFEARVGQQVFSQIPLRDAVIALHQLTLSLAKQWPVPAIKRPTLPDPNGSGLDQHGFWQQIQDFLRPGDILIAEQGTACFGAAALGLPQGCRFIVQSLWGSIGYTLPAAFGAQTAEPDRRVVLLIGDGSAQLTAQELGSMLRDGQKPVIFLLNNEGYTVERAIHGPQQRYNDIAQWNWTQLPQALAGEHQVKTLRVADPQQLRQALKEVGDSPQLAFVEVMLPKMDIPELLDSVSRAIHSRNAAA

SEQ ID NO: 277 - protein, 550 aa, Leishmania major strain Friedlin
MPFNGYTVGCHLLDRLVEAGCEHLFGVPGDFNLRFLDDVMAHTRMKWVGTANELNAAYAADGYARQRGLGAVATTYGVGELSALNGIAGSFAESVPVIHIAGAASTKSQGNRELLHHSLGDGNHMHFLNISAEVCCIAVMLTPENCLTEIDRVITEVLYQKKPGYVALPTDVAEMIVPPPAAKLTRRLPEVSLESVSAFKHTIASRLHSARNPAVLTGHLIHRHQCGPQVNHFLENIRIPYAPAVLGKGAVNEHLENYVGTYIAGDEPCPSKSIIESADVCISIGVQFVDTVTSVFRHKIDPLKMIDIQPFFAKVGDQVFYQVPMEMAVKAVEEAAMEFHTNWSTEYPEPERLRYPESPDTFDLCHVWQEINNGLRPNDVLLVDLGTSSFTSALLRLPQGCDMLCQQMWASIGYTLPAAIGAQIADESRSVVCILGDGAAQMTVQELGTAARYKLKPKYILINNDGYTIERYIRGWDSSYNDISVWNWTGLARNLCKGAEPRTCVVNSVGGVEATLHEKQDNMVFVEVLVGKYEGPLRSPVLLPGKPASK

SEQ ID NO: 278 - protein, 569 aa, Mycobacterium leprae TN
MTAPKIEAVYTVGAYLLDRLAELGVTEIFGVPGDYTLEFLDHIVAHPTIRWVGNANELNAGYAADGYGRLRGISALVTTFGVGELSAANAIAGSYAEHVPVVHIVGAPPKDAQSTHRALHHSLGDGDFEHFIRISSEITCSQANLTTATACKEIDRVLSEVRKHKRPGYILLSTDVARFPTEPPAAPLPGHTDGTSPRALSLFIDAATKLIADKRMTVLADLLVHRLQVVKELETLLTADVVPYATLMWGKSLLDESSPNFLGIYAGAASTEAVRAAIEQAPVLVTAGVVFTDMVSGFFSQRIDPARTIDVGQYQSSVADKVFTPLEMGDALEALASILVRRGVSSPPVELPPGNPTADTPSPTQRLTQQILWDRLCAALTPGNVVLADQGTAFYGMVEHRLPRGVTFIGQPLWGSIGYTLPAALGAGLAHRNRRTVLLLGDGAAQLTIQELGSFYREGLSPVIVVVNNDGYTIERAIHGATAPYNNIARWRWTDIPGALGVANHSSFRAETYGELDEAFAVAAELKDQMVFVEVIVPKLDLPSLLTALTRPAQDSNRIFQLPNPGWDN

SEQ ID NO: 279 - protein, 560 aa, Mycobacterium tuberculosis CDC1551
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTNMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 280 - protein, 546 aa, Staphylococcus aureus subsp. aureus Mu50
MKQRIGAYLIDAFHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTATKDTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNSATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 281 - protein, 550 aa, "Salmonella enterica subsp. arizonae serovar 62:z4,z23:--"
MQTPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFHHFYRMSQAISAGSAILNEQNACFEIDRVLGEMVAARRPGYIMLPADVAKKTAIPPIEALTLPAHETQNGVETAFRYRARQCLMNSRRIALLADFLARRFGLRPLLQRWMAETSIAHATLLMGKGLFDEQHPNFVGTYSAGASSKAVRQAIEDADMVICVGTRFVDTLTAGFTQQLPAERTLEIQPYASRIGETWFNLPMAQAVSTLRELCLECAFAPPPTRPVCQPVQIEKGELTQENFWQTLQQYLKPGDIILVDQGTAAFGAAALSLPDGAEVVVQPLWGSIGYSLPAAFGAQTACPDRRVILIIGDGAAQLTIQEMGSMLRDGQAPIILLLNNDGYTVERAIHGAAQRYNDIASWNWTQIPQALNAAQQAECWRVTQAIQLAEVLERLARPQRLSFIEVMLPKADLPELLRTVTRALEARNGG

SEQ ID NO: 282 - protein, 550 aa, Salmonella enterica subsp. enterica serovar Paratyphi B str. SPB7
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 283 - protein, 558 aa, Bacillus anthracis str. A0488
MKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGTPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 284 - protein, 550 aa, Salmonella enterica subsp. enterica serovar Typhi str. CT18
MQNPYTVADYLLDRLAGCGIGHLFGVPGDYNLQFLDHVIDHPTLRWVGCANELNAAYTADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQCLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 285 - protein, 550 aa, Salmonella enterica subsp. enterica serovar Typhimurium str. LT2
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 286 - protein, 550 aa, Salmonella enterica subsp. enterica serovar Kentucky str. CDC 191
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISVASAILDEQNACFEIDRVLGEMFAARRPGYIMLPADVAKKTAIPPTQALTLPVHEAQSGVETAFRYHARQCLMNSRRIALLADFLAGRFGLRPLLQRWMVETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLVRPQRLSFIEVMLPKADLPELLRTVTRALEARNGG

SEQ ID NO: 287 - protein, 550 aa, Salmonella enterica subsp. enterica serovar Schwarzengrund str. SL480
MQNPYTVADYLLDRLAGCGIGHLFGVPGDYNLQFLDHVIDHPTLRWVGCANELNAAYAADGYARMSGTGALLTTFGVGELSAINGIAGSYAEYVPVLHIVGAPCSAAQQRGELMHHTLGDGDFRHFYRMSQAISVASSILDEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILVIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 288 - protein, 550 aa, Salmonella enterica subsp. enterica serovar Heidelberg str. SL486
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPTERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 289 - protein, 550 aa, Salmonella enterica subsp. enterica serovar Hadar str. RI_05P066
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPTERTLEIQPYASRIGETWFNLPMAQAVSTLRELCLECAFAPPPTRSAGQPVRIDKGELTQESFWQTLQQYLKPGDIILVDQGTAAFGAAALSLPDGAKVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 290 - protein, 550 aa, Salmonella enterica subsp. enterica serovar Weltevreden str. HI_N05-537
MQNPYTVADYLLDRLAGCGIGHLFGVPGDYNLQFLDHVIDHPTLRWVGCANELNAAYTADGYARMSGAGALLTTFGVGELSAINGIAGSYAEYVPVLHIVGAPCSAAQQRGELMHHTLGDGDFRHFYRMSQAISVASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQGIQLAEVLERLARPQRLSFIEVMLPKADLPELLRTVTRALEARNGG

SEQ ID NO: 291 - protein, 503 aa, Acinetobacter baumannii SDF
MFIEIGELLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGIGARFTDVGSAVFTHQIEIKNYIEIKSYGLNIFGQDFPGIEIGQLLVELNKKVAPRKSSIPLLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYSEIPAVFNGKKGHTTYCG

SEQ ID NO: 292 - protein, 573 aa, Acinetobacter baumannii AYE
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPFLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPVKCKDAISF

SEQ ID NO: 293 - protein, 558 aa, Bacillus anthracis str. A0389
MKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGIPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 294 - protein, 566 aa, Mycobacterium marinum M
MTLLENDAATDPVYTVGDYLLDRLAELGVSEIFGVPGDYNLEFLDHIVAHPTIRWVGSANELNAGYAADGYGRLRGMSAVVTTFGVGELSATNAIAGSYAEHVPVVHIVGGPSKDAQGARRALHHSLGDGDFEHFFRISREITCAQANLMPATACREIDRVLCEVREQKRPGYLLLSTDVARFPTEPPGAPLPPLAGGTSPRALSLFTRAAADLIGDHQLTVLADLLVHRLQAVKELEAVLSADVVPHATLMWGKSLLDESSANFLGIYAGAASAEPVRTAIECAPVLVTAGVVFTDMVSGFFSQRIDPARTIDIGQYQSSVADQVFAPLEMGAALQAVATILTKRGINSPPVAVPPAEPGPPTPGRDEPLNQEMLWNRLCEALTPGNVVLADQGTSFYGMADHRLPQGVTFIGQPLWGSIGYTLPAALGAAVAHPDRRTVLLIGDGAAQLTVQELGIFSREGLSPVIVVVNNDGYTVERAIHGETATYNDIVSWRWTDVPGALGVTNHLAMRAENYGELDDALTAAAEQQDRMVVVEAVLPRLDVPPLLDELVGSLSPPECGGRS

SEQ ID NO: 295 - protein, 573 aa, Acinetobacter baumannii ACICU
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPLLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVHQNDQLTFIELKLPAMDAPVSLKKFASVIARFDYGDRGYEILKERSQPVKCKDAISF

SEQ ID NO: 296 - protein, 550 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQANADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELSKQHVHTGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEARN

SEQ ID NO: 297 - protein, 558 aa, Nostoc punctiforme PCC 73102; identical to SEQ ID NO: 62

SEQ ID NO: 298 - protein, 551 aa, Erwinia tasmaniensis Et1/99
MMNKYTVGDYLLTRLNEIGIGHLFGVPGDYNLQFLDHVIDNPDVVWVGCANELNAAYAADGYARCRGAAALLTTFGVGELSAINGVAGSYAEYLPVVHIVGAPSQTSQNNAELLHHTLGDGDFGHFIRMQQEISVASSVLTPTNAAAEIDRVLVEALTRRRPVYLLLATNVAESLLSPPSSPLPLRLHCDQEQLAAFVDAAQSLLASANSVALLADFLADRAAQRQRLQRWLTEVPMPFATLLMGKSVLPEMLYGFAGTYAGASSADSTRDVIESSDVLISVGVKYTDTITAGFTQRIARSQNIDVGLHASSVAGQNFEQIPMADALKALHQLAQQYGQGWQQGIVAPPVSVEQPSDALTQNTFWHAIQDFLRPGDIVLADQGTAAFGTAVLRLPQDVRLLIQPLWGSIGYTLPAAFGAQTARPQQRVVLIIGDGSAQLTVQELGSMLRDGQKPVIFLLNNDGYTVERAIHGAQQRYNDIAHWDWTRLPQTLDVGSDAQSWRVTHTAQLREIMQRLEHREQLSLVEVVLPRLDVPPLLASVSRALHQRNGS

SEQ ID NO: 299 - protein, 563 aa, Mycobacterium avium 104
MPVTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALAAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNSLGVTDHLAFRVQTYGELDDALTAAARHQDRMVLVEVVLPRLEIPRLLVELVRPTSPDGSPRR

SEQ ID NO: 300 - protein, 558 aa, Bacillus cereus W
MKTHYTVSTYLLDRLSELGIEHIFGIPGDYNLAFLDDVIAHEKLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 301 - protein, 550 aa, Salmonella enterica subsp. enterica serovar Agona str. SL483
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 302 - protein, 550 aa, Salmonella enterica subsp. enterica serovar Virchow str. SL491
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISVASAILDEQNACFEIDRVLGEMLVARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTVGFTQQLPTERTLEIQPYASRIGETWFNLPMAQAVSTLRELCLECAFAPPPTRSAGQPVRIDKGELTQESFWQTLQQYLKPGDIILVDQGTAAFGAAALSLPDGAKVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 303 - protein, 550 aa, Salmonella enterica subsp. enterica serovar Javiana str. GA_MM04042433
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISVASAILYEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSTGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 304 - protein, 550 aa, Salmonella enterica subsp. enterica serovar Gallinarum str. 287/91
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPTERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAARRYNDIASWNWTQIPPALNAAQQAECWRVTQAIQLAEVLERLARPQRLSFIEVMLPKADLPELLRTVTRALEARNGG

SEQ ID NO: 305 - protein, 553 aa, Klebsiella pneumoniae 342
MQPTYTIGDYLLDRLVDCGIDRLFGVPGDYNLQFLDRVIAHSALGWVGCANELNAAYSADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFREHASRLLRGSRRISLLADFLAQRYGLQNTLREWVAKTPIAHATMLMGKGLFDEQLNGFVGTYSGIASAPQTREAIENADTIICIGTRFTDTITAGFTQHLAREKTIEIQPFAVRVGDHWFSGVPMDQALAALMTLSAPLAAEWAAPQVVAPEVEEEGEGELTQKNFWSTVQDALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVVSRCWRVTHTAELREAMAESITSDTLTLVEVMLPKMDIPDFLRAVTQALEERNSRV

SEQ ID NO: 306 - protein, 558 aa, Bacillus cereus AH1134
MKKQYTVSTYLLDRLHELGIEHIFGVPGDYNLAFLDDVVAHKNLKWIGNCNELNAAYAADGYARIKGIAALITTFGVGELSAINGIAGSYAENVPVIKITGTPPTKVMENGAIVHHTLGDGKFDHFSNMYREITIAQTNVTPEHAAEEIDRVLRACWNEKRPVHINLPIDVYNKPINKPTEPIINKPILSNKEALNKMLLHAISKINSAKKPVILADFEVDRFHAKESLHQFVEKTGFPIATFSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFNPKAQMVTQKRFWQQMYHFLQENDVLVVEQGTPFFGSAAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGSEEKSLTFKVENEAELAEVLTNITFNKNQLIFIEVIMSQSDQPELLAKLGKRFGQQNS

SEQ ID NO: 307 - protein, 558 aa, Bacillus cereus H3081.97
MKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYRELTVAQSKLTPEHAAEEIDRVLRACWSAKRPVHIQLPIDVYNKPINKPTEPILHKPVVSNKDALDKMLLHATSKINSAKKPVILADFEVERFHAKEYLYQFVEKTGFPIATLSMGKGIFPEKHPQFIGIYTGDVSSPYLRKRIDESDCIISIGVKLTDTITGGFTQGFMKEQVIEIHPYTVKITDKKYGPVVMKDVLQHLSDLIEHRNGETLDIKPFISESLSITEKFNPKPQMVTQKRFCQQIYHFLQEKDVLLAEQGTPFFGSATIPLPNDTTYVAQPLWGSIGYTLPALLGTQLANLSRRNILIIGDGSFQLTVQELSTILRQNLNPIIFLINNNGYTVERAIHGQNEPYNDIQMWDYTKLANVFGTEEKSLTCKVENEIELQEVLTKISNDKDQLTFVEVVMSQGDQPELLAKLGKRFGQQNS

SEQ ID NO: 308 - protein, 546 aa, Staphylococcus aureus subsp. aureus MW2
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEHAGKYVHHSLGEGTFDDYRKMFAHITVAQGYITPENATTEIPRLINTAIAERRPVHLHLPIDVAISEIEIPTPFEVTAAKDTDASTYIELLTSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 309 - protein, 516 aa, Salmonella enterica subsp. enterica serovar Typhi str. E98-0664
LDHVIDHPTLRWVGCANELNAAYTADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTEALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQCLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 310 - protein, 573 aa, Acinetobacter baumannii AB307-0294
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPLLEKQPQKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPVKCKDAISF

SEQ ID NO: 311 - protein, 558 aa, Bacillus cereus AH187
MKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDRVLRACWSAKRPVHIQLPIDVYNKPINKPTEPILHKPVVSNKDALDKMLLHATSKINSAKKPVILADFEVERFHAKEYLYQFVEKTGFPIATLSMGKGIFPEKHPQFIGIYTGDVSSPYLRKRIDESDCIISIGVKLTDTITGGFTQGFMKEQVIEIHPYTVKITDKKYGPVVMKDVLQHLSDLIEHRNGETLDIKPFISESLSITEKFNPKPQMVTQKRFCQQIYHFLQEKDVLLAEQGTPFFGSATIPLPNDTTYVAQPLWGSIGYTLPALLGTQLANLSRRNILIIGDGSFQLTVQELSTILRQNLNPIIFLINNNGYTVERAIHGQNEPYNDIQMWDYTKLANVFGTEEKSLTCKVENEIELQEVLTKISNDKDQLTFVEVVMSQGDQPELLAKLGKRFGQQNS

SEQ ID NO: 312 - protein, 558 aa, Bacillus cereus B4264
MKKQYTISAYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITIAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKQPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSAAIPLPNNTAYVGQPLWGSIGYTLPALLGTQLANLSRRNILIIGDGSFQVTAQELSTVLRHNLKPIIFLINNNGYTVERAIHGQNQPYNDIQIWDYNKLSMVFGAEEKSLTFKVENESELAEVLTNITFNKNQLIFIEVIMSQSDQPELLAKLGKRFGQQNS

SEQ ID NO: 313 - protein, 558 aa, Bacillus cereus AH820
MKTQYTVSTYLLDRLSELGIEHIFGVPGDYNLAFLDYVLAHKNLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 314 - protein, 546 aa, Staphylococcus aureus subsp. aureus str. JKD6008
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGAYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVMYFVEVKMSVEDAPKKLIDIAKAFSQQNK

SEQ ID NO: 315 - protein, 561 aa, Bacillus cereus Q1
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDRVLRACWSAKRPVHIQLPIDVYNKPINKPTEPILHKPVVSNKDALDKMLLHATSKINSAKKPVILADFEVERFHAKEYLYQFVEKTGFPIATLSMGKGIFPEKHPQFIGIYTGDVSSPYLRKRIDESDCIISIGVKLTDTITGGFTQGFMKEQVIEIHPYTVKITDKKYGPVVMKDVLQHLSDLIEHRNGETLDIKPFISESLSITEKFNPKPQMVTQKRFCQQIYHFLQEKDVLLAEQGTPFFGSATIPLPNDTTYVAQPLWGSIGYTLPALLGTQLANLSRRNILIIGDGSFQLTVQELSTILRQNLNPIIFLINNNGYTVERAIHGQNEPYNDIQMWDYTKLANVFGTEEKSLTCKVENEIELQEVLTKISNDKDQLTFVEVVMSQGDQPELLAKLGKRFGQQNS

SEQ ID NO: 316 - protein, 546 aa, Staphylococcus capitis SK14
MKQRVGQYLIDAVYAAGVDKVFGVPGDFNLAFLDDIISHEHIEWIGNTNELNASYATDGYARINGLGAMVTTFGVGELSAVNGIAGSYAERVPVIAITGAPTRAVEEAGKFVHHSLGEGTFDDYRKMFEPITTAQGYITPENATTEIPRLINAAIQERRPVHLHLPIDVALAEIEVSETFQPEDVPHQDVKKYIDMIEDKLKSADQPLIIAGHEINSFNLHKELEEIVNQTNIPVAQLSLGKGAFNEENPHYIGVFDGEIAEDKIKDYVNNSDAILNIGAKLTDSATAGFSYEFDIDDVVMINHKNFKMNDTVANDVTLPSLIHGLKDLHFENKNDYLQYERPQKNNYELSDQPLTQETYFNMIQDFLQLDDILIAEQGTSFFGAYDLAMHKNNTFIGQPLWGSIGYTLPATLGTQIADPQRRNVLLIGDGSLQLTVQSLSTMIRQNLKPVIFVINNDGYTVERMIHGMKEPYNDIRMWDYKALPAVFGGDNVEVHDVNTSEELKRAFEKINANSDRMHYVEVKMAVEDAPVKLSEIAKAFASQNK

SEQ ID NO: 317 - protein, 548 aa, Staphylococcus carnosus subsp. carnosus TM300
MMKKRVGEYLMDCLSNTGVEKVFGVPGDFNLAFLDDIISRDDIEWVGNTNELNASYAADGYARMKGISAMVTTFGVGELSAVNGIAGSYAERVPVVAITGAPTRAVEDAGKYVHHSLGEGTFDNYRKMFKEITTAQGYITPENAQTEIPRLLDAALAEKRPVHLHLPIDVAMTEIEVESTYEVPERKVEDVSKYIAMVKDKLESASQPVIIAGHEINSFKLHEQLEDFVNKTHIPVAQLSLGKGAFNEENPYYMGIYDGSIAEENIRDYVDNSDAILNIGAKLTDSATAGFSFEFDIDDVVMLNQHNFKMNETVAEDVTLPDLMDGLMEMDYVNEADYPKFKRPETGQYELNGDALTQETYFKMMQDFLAPSDVILAEQGTSFFGAYDLALYKGNKFVGQPLWGSIGYTLPATIGTQIADPKRRNLLLIGDGSLQLTVQGISTMIRQGLKPVLFVINNDGYTVERKIHGENEPYNDIFMWDYKALPAVFGGEDVVKVRDVSTSEELDQAFEAIKAYPDMMHFVEVKMAMHDAPHKLDAIGKAFAKQNS

SEQ ID NO: 318 - protein, 550 aa, Salmonella enterica subsp. enterica serovar Paratyphi C strain RKS4594
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPTERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGAIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 319 - protein, 555 aa, Pectobacterium carotovorum subsp. brasiliensis PBR1692
MSENYTVGDYLLDRLTQIGIQHLFGVPGDYNLHFLDHVIRHPEIAWVGCANELNAAYAADGYARCRPAAALLTTFGVGELSAINGIAGSYAECLPVIHIAAAPSLASQHNGELLHHTLGDGDFSHFSRMAAEVTVAQASLTVENATTEIDRVIGEALAQHKPVYLFLPLDVAAAPAGTRPYSLVIPEPLRSDESLQAFVTAATEMLSEAKSVSLLADFLAQRVGVAEQIQRWLDKTPLPHATLLMGKGTLNEQHRSFTGTYAGGGSHETIRAHIEDADVIISIGVRYTDTITTGFSHQIPSEKNIDIQPTLARVGSQVFPAIPMSDAIAALEKITAILAPRWDHRTITPPALPPSEHTDTLNQRELWQQMQRFLRSGDILVTDQGTSCFGAAALRLPSHCHFIVQPLWGSIGYSLPAAFGAQIAEPERRVVLLIGDGSLQLTVQELGSIIRDRLNIVIVVLNNEGYTVERAIHGPEQRYNDIAAWNWTQLPAALGADENEILCEQVCSPVALAQVLEQVNATSRFSLIEVVLPRMDIPALLHTITQSLETRNTVQ

SEQ ID NO: 320 - protein, 549 aa, Corynebacterium striatum ATCC 6940
MYTIGDYLLDRLAEVGITELFGVPGDFNLKFLDHVVAHEKIRWVGNSNELNAGYAADGYARLRGIGAFLTTFGVGELSAANAIAGSYAENVPVIHIVGSPRKELQASVAKIHHSMGDGDFARFFRVDRELTCVAEDLNAMTAQAQIDNLIVQVLFQRKPGALHLAADVASTPCTPPKAPLPLIEQFDSEAAAQEFERDLKGFLKGRTLAVLADVLVHRFGCQSTLQGYLDRSGVPVATLSWGKSLIDEETSNFAGIYSGAASHGDTRKTVEEATALVTVGVDFTDNITAGFSVAISQDNQVDIRRDTAYIQGNAYTPLSMGRAIEILDQVTAEVSPEFMPVGKTNPAEKVEITDEPLSQEQLWAVVSRALEPGNVVIAEQGTSFFGLSAHHFPTDTVFIGQPMWGSIGYTLPATLGAALAQPGRRPVLLIGDGSAQLTIQEIGQMVREKVPAAIFLVNNNGYTVERAINGEDEYYNDIPAWDWSKTLDFFGAGDFGLTLRATTGAELEEAVAVATANKDKLVFVEAVTPYNDYPEQLKRVAAALAPRKR

SEQ ID NO: 321 - protein, 557 aa, Corynebacterium striatum ATCC 6940; identical to SEQ ID NO: 57

SEQ ID NO: 322 - protein, 546 aa, Staphylococcus aureus subsp. aureus MN8
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGAYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVIHFVEVKMSVEDAPKKLIDIAKAFSQQNK

SEQ ID NO: 323 - protein, 557 aa, Corynebacterium aurimucosum ATCC 700975
MQTTIGDFILDRLKAIGITEIIGVPGDFNLSFLEQIEASEGIRFVGACNELNAAYAADGYARQRGVGCLLTTYGVGELSALNGIAGARAEHVPLVSLAGAPPQYATEFRWNLHHSLADGDFANMLDSFAPFTEVATRVSPMNVVEEFDRALHTCLREKRPVHIQIPSDITHLSIEVPDEPFSTELAPSDPERLNAAADYVLEHLAKAKDPIILIDQDTNRHGFTEKFRAIIDKAQLPYSQLSSGKAILSERHPLFIGTYNGAASAPGVQERIEKSDFLVTTNPRFIEVNSGSFTHNLADARVYNFGDQHLNADGEYFVGINTLELLDVLLDRIPEAGASTSAAFEPEPFEPNPDAPLTQERIWPQMLGFIQEDDVVIAEAGTSNIGLGQQRMPEGVQYINSTIWGSIGFTLPCVLGSQLANPKRRHVLFIGDGSFQLTAQELSTILRQDLKPIIVLVNNDGYTIERYILGMEREYNEIQMWDYTALPKAFMKDTTMESYVASTESELAKALDDIAAHPERGAFLEVRLDAFDAPKGLQAFGPQTADFDFGPRGPRNA

SEQ ID NO: 324 - protein, 546 aa, Staphylococcus aureus subsp. aureus TCH60
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGAYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVMHFVEVKMSVEDAPKKLIDIAKAFSQQNK

SEQ ID NO: 325 - protein, 546 aa, Staphylococcus hominis SK119
MKQRVGQYLMDAVHEAGVNKIFGVPGDFNLAFLDDIVSHEGVEWVGTTNELNGAYTADGYARMNGLGVLVTTFGVGELSAVNGIAGSYAERVPVIAITGAPTRAVEKAGKYVHHSLGEGRFDSYRHMFEPITTAQAYITPENATTEIPRVINAALQERRPVHIHLPIDVAMSDIEVEQPFKVEKAPQQDVTQYVDMLANQLRSAQQPLIIAGHEINSFHLHDELEQFVNKTNIPVVQLSLGKGAFNEENPHYMGIYDGKIAKDDIKDYVDHSDAILNIGAKLTDSATAGFSYQFDINEVVMINHRLFKLNDTIDTEIALPEFLEALNTIDYTNKSSFPSYQQPESNDYELTDDMLTQDIYFKMMQDFIGGDDILIAEQGTSFFGAYSLTLPKNMSFIGQPLWGSIGYTLPATLGSQLANPHRRNILLIGDGSFQLTVQELSTMIRQDIKPVIFLINNDGYTVERLIHGMEEPYNDINMWDYKALPNVFGGDSVKVHDVKTSKDLKAVFDEINEDQEHMHFTEVTMKWDDAPQTLRDISKAFANQNK

SEQ ID NO: 326 - protein, 561 aa, Bacillus thuringiensis serovar pulsiensis BGSC 4CC1
MIHLKTHYTVSTYLLDRLSELGIEHIFGFPGDYNLAFLDDVIAHEKLEWIGNCNELNAAYAADGYARIKGIAALITTFGVGELSAINGIAGSYAENVPVIKITGTPPTTVMENGELVHHTLGDGKFDHFSKMYREITIAQTNLTPEHAVEEIDRVLRACWNEKRPVHINLPIDVYNKPINKPAEPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQMSHLLQENDVLLAEQGTPFFGSAAIPLPNNTTYVAQPLWGSIGYTLPALLGTQLANLSRRNILIIGDGSFQLTVQELSTILRQNLNPIIFLINNNGYTVERAIHGQNEPYNDIQMWDYTKLANVFGTKEKSQTFKVENETELQEVLTKISIDKNQLTFVEIVMSQGDQPELLAKLGKRFGQQNS

SEQ ID NO: 327 - protein, 561 aa, Bacillus thuringiensis serovar andalousiensis BGSC 4AW1
MIHLKTHYTVSTYLLDRLSELGIEHIFGIPGDYNLAFLDDVIAHEKLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPGLLAKLGKRFGQQNS

SEQ ID NO: 328 - protein, 561 aa, Bacillus thuringiensis serovar berliner ATCC 10792
MIHLKKQYTVSTYLLDRLHELGIEHIFGVPGDYNLAFLDDVVAHENLKWIGNCNELNAAYAADGYARIKRIAALITTFGVGELSAINGIAGSYAENVPVIKITGTPPTKVMENGAIVHHTLGDGKFDHFSNMYREITVAQTNVKPEHAAEEIDRVLRACWNEKRPVHINLPIDVYNKPINKPTEPILYKPILSNKEALDKMLLHATSIINNAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFNPKAQMVTQKRFWQQMYHFLQENDVLIVEQGTPFFGSAAIPLPNNTAYVGQPLWGSIGYTLPALLGTQLANLSRRNILIIGDGSFQVTAQELSTILDQNLKPIIFLINNNGYTVERAIHGQNQPYNDIQMWDYNKLSMVFGSEEKSLTFKVENEAELAEVLTNITFNKNQLIFIEVIMSQSDQPELLAKLGKRFGQQNS

SEQ ID NO: 329 - protein, 561 aa, Bacillus thuringiensis serovar monterrey BGSC 4AJ1
MIHLKTQYTVSTYLLDRLSELGIEHIFGVPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLNKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIKHRNEETLDIKPFISESLSMTEEFNPKAHMVTQKRFWQQIYHFLQENDVLLAEQGTPFFGSAAIPLPNNTTYVAQPLWGSIGYTLPALLGTQLANLSRRNILLIGDGSFQLTVQELSTILRQNLKPIIFLINNNGYTVERAIHGQNEPYNDIQMWEYTKLANVFGTEEKSQTFKVQNETELQEVLTKISIDKNQLTFVEIVMSQGDQPELLTKLGKRFGQQNS

SEQ ID NO: 330 - protein, 561 aa, Bacillus thuringiensis serovar kurstaki str. T03a001
MIHLKKQYTVSTYLLDRLHELGIEHIFGVPGDYNLAFLDDVVAHKNLKWIGNCNELNAAYAADGYARIKGIAALITTFGVGELSAINGIAGSYAENVPVIKITGTPPTKVMENGAIVHHTLGDGKFDHFSNMYREITIAQTNVTPEHAAEEIDRVLRACWNEKRPVHINLPIDVYNKPINKPTEPILYKPILSNKETLDKMLLHATSIINNAKKPVILADFEVDRFHAKESLHQFVEKTGFPIATFSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILETSPFTEEFNPKAQMVTQKRFWQQMYHFLQENDVLIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMIFGSEEKSLTFKVENEAELAETLVNIIFNKNQLIFIEVIMSQSDQPELLAKLGKRFGQQNS

SEQ ID NO: 331 - protein, 561 aa, Bacillus thuringiensis serovar tochigiensis BGSC 4Y1; identical to SEQ ID NO: 64

SEQ ID NO: 332 - protein, 561 aa, Bacillus cereus AH1271
MIHLKTQYTVSTYLLDRLSELGIEHIFGVPGDYNLAFLDDVVAHEKLKWVGNCNELNAAYAADGYARIKGIAALITTFGVGELSAINGVAGSYAENVPVIKITGTPTTKVMENGALVHHTLGDGKFDHFSNMYREITVAQTNLTAEHAAEEIDRVLRACWSEKRPVHINLPIDVYNKPINKPTESILHKPVVSNKEALDKMLIHATSKINSAKKPVILADFEVNRFHAEEYLYQFVKKTGFPIATLSMGKGIFPEKHPQFVGIYTGDVSSAYLRKRIDESDCIISIGVKLTDTITGGFTQGFTKGQVIEIHPYTVKIIDKTYGPVVMKDALEQLSDLIEHRIEETLEIKPFISESLSITEEFNPKAQLVTQKRFWQQIYHFLQENDVLIAEQGTPFFGSAAIPLPNNTTYVAQPLWGSIGYTLPALLGTQLADLSRRNILIIGDGSFQLTVQELSTILRQNLKPIIFLINNNGYTVERAIHGQNQLYNDIQMWDYTKLANVLGSEEKSLTYKVENETELAEVLTNISLNKNQLIFIEVVMSQGDQPELLAKLGERFGKQNS

SEQ ID NO: 333 - protein, 561 aa, Bacillus cereus AH676
MIHLKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFANMYREITVAQTNVTPEHAAEEIDRVLRACWNEKRPVHINLPIDVYNKPINKPTEPILYKPILSNKEALDKMLLHATSIINNAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIAHRNKDTLEIKPFISAPSPFTEEFNPKAQMVTQKRFWQQMYHFLQENDILIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQPYNDIQMWDYNKLSMVFGSEEKSLTFKVENEAELAEVLTNITFNKNQLIFIEVIMSQSDQPELLAKLGKRFGQQNS

SEQ ID NO: 334 - protein, 561 aa, Bacillus cereus F65185
MIHLKKQYTVSTYLLDRLHELGIEHIFGVPGDYNLAFLDDVIAHKSLKWIGNCNELNAAYAADGYARIKGIAALITTFGVGELSAINGIAGSYAENVPVIKITGTPTTKVMENGAIVHHTLGDGKFDHFSNMYREITIAQTNVTPEHAAEEIDRVLRACWNEKRPVHINLPIDVYNKPINKPTEPIINKPILSNKEALNKMLLHAISKINSAKKPVILADFEVDRFHAKESLHQFVEKTGFPIATFSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFNPKAQMVTQKRFWQQMYHFLQENDVLIVEQGTPFFGSAAIPLPNDTAYVGQPLWGSIGYTLPALLGTQLANLSRRNILIIGDGSFQVTAQELSTILRQNLKPIIFLINNNGYTVERAIHGQNQPYNDIQMWDYNKLSMIFGSEEKSLTFKVENEAELAETLANIIFNKNQLIFIEVIMSQSDQPELLAKLGKRFGQQNS

SEQ ID NO: 335 - protein, 561 aa, Bacillus cereus Rock4-2
MIHLKKQYTVSTYLLDRLHELGIEHIFGVPGDYNLAFLDDVIAHKSLKWIGNCNELNAAYAADGYARIKGIAALITTFGVGELSAINGIAGSYAENVPVIKITGTPPTKVMENGAIVHHTLGDGKFDHFSNMYREITIAQTNVTPEHAAEEIDRVLRACWNEKRPVHINLPIDVYNKPINKPTEPIINKPILSNKEALNKMLLHAISKINSAKKPVILADFEVDRFHAKESLHQFVEKTGFPIATFSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFNPKAQMVTQKRFWQQMYHFLQENDVLIVEQGTPFFGSAAIPLPNDTAYVGQPLWGSIGYTLPALLGTQLANLSRRNILIIGDGSFQVTAQELSTILRQNLKPIIFLINNNGYTVERAIHGQNQPYNDIQMWDYNKLSMIFGSEEKSLTFKVENEAELAEVLTNIIFNKNQLIFIEVIMSQSDQPELLAKLGKRFGQQNS

SEQ ID NO: 336 - protein, 561 aa, Bacillus cereus Rock3-29; identical to SEQ ID NO: 65

SEQ ID NO: 337 - protein, 561 aa, Bacillus cereus Rock3-28
MILLKTQYTVSTYLLDRLHELGIEHIFGVPGDYNLAFLDDVIAHENLEWIGNCNELNAAYAADGYARIKGVATLITTFGVGELSAINGIAGSYAENVPVIKITGTPTTTVIENGELVHHTLGDGKFDHFSNMYREITVAQTNLIPEHAAEEIDRVLRACWNEKRPVHINLPIDVYNKPINKPTEPILNHPIVSNKDALDKMLLHATSKINSAKKPVILADFEVDRFHAQEDLHQLVEKTGFPIATLSMGKGIFPEKHPQFIGVYTGDVSPPYLRKRVDESDCIISIGVKLTDTITGGFTQGFTKEQVIEIHPYTVKIIDKKYGPVVMKDVLQHLSDSIEHRNEETLEIKSFISESSSITKEFNPKAQIVTQQRFWQQLYHFLQENDVLIAEQGTPYFGSAAIPLPNNATFVGQPLWGSIGYTLPALLGTQLANVTRRNILIIGDGSFQLTVQELSTMLRHNLKPIIFLINNYGYTVERAIHGRDQPYNDIQMWDYNKLPNVFGSEEKSLTFKVENEIELAEVLNKISFNMNRLIFIEVVMSQGDQPELLAKLGKRFGSQNS

SEQ ID NO: 338 - protein, 561 aa, Bacillus cereus Rock1-15
MIHLKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVKPEHAAEEIDRVLRACWNEKRPVHINLPIDVYNKPINKPTEPIINKPILSNKEALNKMLLHAISQINSAKKPVILADFEVDRFHAKENLHQFVEKTGFPIATLSMGKGIFPEKQPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQPYNDIQMWDYNKLSMVFVAEEKSLTFKVENESELAEVLTNITFNKNQLIFIEVIMSQSDQPELLAKLGKRFGQQNS

SEQ ID NO: 339 - protein, 561 aa, Bacillus cereus Rock1-3
MILLKTQYTVSTYLLDRLYELGIEHIFGVPGDYNLAFLDDVIAHKNLEWIGNCNELNAAYAADGYARIKGVAALITTFGVGELSAINGIAGSYAENVPVIKITGTPTTTVMENGELVHHTLGDGKFDHFSNMYREITIAQTNLIPEHAAEEIDRVLRACWNEKRPVHINLPIDVYNKPINKPTEPILNHPIVSNKDALDKMLLHAISKINSAKKPVILADFEVNRFYAEEDLHQLVEKTGFPIASLSMGKGIFPEKHPQFIGIYTGDVSPPYLRKRVDESDCIISIGVKLTDTITGGFTQGFTKEQVIEIHPYTVKIIDKKYGPVVMKDVLQYLINSIKHRNEETFEIKPFISESSSITKEFNPKAQIVTQQRFWQQLYHFLQENDVLIAEQGTPYFGSATIPLPNNASFVGQPLWGSIGYTLPALLGTQLANVTRRNILIIGDGSFQLTVQELSTMLRHNLKPIIFLINNNGYTVERAIHGRDQPYNDIQMWDYNKLPNVFGSEEKSLTFKVENEIELAEVLNKISFNMNRLIFIEVVMSQGDQPELLAKLGKRFGIQNS

SEQ ID NO: 340 - protein, 561 aa, Bacillus cereus 95/8201
MIHLKTQYTVSTYLLDRLSELGIEHIFGVPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 341 - protein, 561 aa, Bacillus cereus BDRD-Cer4
MIHLKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSSAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGAEEKSLTFKVENEAELAAVLTNITFNKNQLIFIEVIMSQSDQPELLAKLGKRSGQQNS

SEQ ID NO: 342 - protein, 561 aa, Bacillus cereus BDRD-ST24
MIHLKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPILYKPILSNKEALDKMLLHATSIINNAKKPVILADFEVDRFHAKENLHQFVEKTGFPIATLSMGKGIFPEKHPQFIGIYTGDVSSPYLRKRIDESDCIISIGVKLTDTITGGFTQGFKKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQPYNDIQMWDYNKLSMVFGAEEKSLTFKVENESELAEVLTNITFNKNQLIFIEVIMSQSDQPELLAKLGKRFGQQNS

SEQ ID NO: 343 - protein, 561 aa, Bacillus cereus m1550
MIHLKKQYTVSTYLLDRLHELGIEHIFGVPGDYNLAFLDDVVAHKNLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAVEEIDRVLRACWNEKRPVHINLPIDVYNKPINKPTEPILYKPILSNKEALDKMLLHATSKIKNAKKPVILADFEVDRFHAKENLHQFVEKTGFPIATLSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLEIKPFILESSPFTEEFNPKAQMVTQKRFWQQMYHFLQENDVLIVEQGTPFFGSADIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGSEEKSLTFKVENEAELAEVLTNITFNKNQLIFIEVIMSQSDQPELLAKLGKRFGQQNS

SEQ ID NO: 344 - protein, 561 aa, Bacillus cereus ATCC 4342
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDRVLRACWSAKRPVHIQLPIDVYNKPINKPTEPILHKPVVSNKDALDKMLLHATSKINSAKKPVILADFEVDRFHAKEYLYQFVEKTGFPIATLSMGKGIFPEKHSQFIGIYTGDVSSPYLRKRIDESDCIISIGVKLTDTITGGFTQGFTKEQVIEIHPYTVKITDKKYGPVVMKDVLQQLSDLIEHRNKNDLEIKPFLSESSSFTEEFNPKAQMVTQKRFWQQIYHFLQENDVLLVEQGTPFFGSSDIPLPNNTTYVAQPLWGSIGYTLPALLGTQLANLSRRNILIIGDGSFQLTVQELSTILRQNLNPIIFLINNNGYTVERAIHGQNEPYNDTQMWEYTKLANVFGTEEKSQTFKVENETELQEVLTKISIDKDQLTFVEIVMSQGDQPELLAKLGKRFGQQNS

SEQ ID NO: 345 - protein, 561 aa, Bacillus cereus MM3
MIHLKTQYTVSTYLLDRLRELGIEHIFGVPGDYNLAFLDDVLAHEKLKWIGNCNELNAAYTADGYARIKGIAALITTFGVGELSALNGVAGSYAENVPVIKITGTPPTTVMENGALVHHTLGDGKFDHFSNMYREITVAQSKLTPEHAAEEIDRVLRACWSEKRPVHIQLPIDVYNKPINKPTEPILHKPVLSNKDALDKMLLHATSKINSAKKPVILADFEVARFHAEEYLHQFVEKTGFPIATLSMGKGIFPEKHPQFIGIYTGDVSSPYLRKRIDESDCIISIGVKLTDTITGGFTQGFMKEQVIEIHPYTVKIIDKTYGPIVMKDVLEQLSDLIEHRIEETLEIKPFISESLSITEEFNPKAQMVTQKRFWQQIYHFLLENDVLIAEQGTPFFGSAAIPLPNNTTYVAQPLWGSIGYTLPALLGTQLADLSRRNILIIGDGSFQLTVQELSTILRQNLKPIIFLINNNGYTVERAIHGQNEPYNDIQMWDYTKLANVLGSEEKSLTYKVENEIELAEVLTNISLNKNQLIFIEVVMSQGDQPELLAKLGERFGKQNS

SEQ ID NO: 346 - protein, 561 aa, Bacillus cereus 172560W
MIHLKKQYTVSTYLLDRLHELGIEHIFGVPGDYNLAFLDDVVAHKNLKWIGNCNELNAAYAADGYARIKGIAALITTFGVGELSAINGIAGSYAENVPVIKITGTPPTKVMENGAIVHHTLGDGKFDHFSNMYREITIAQTNVTPEHAAEEIDRVLRACWNEKRPVHINLPIDVYNKPINKPTEPILYKPILSNKETLDKMLLHATSKINSAKKPVILADFEVDRFHAKESLHQFVEKTGFPIATFSMGKGIFPEKHPQFIGVYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFNPKAQMVTQKRFWQQMYHFLQENDVLIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGSEEKSLTFKVENEAELAEVLTNITFNKNQLIFIEVIMSQSDQPELLAKLGKRFGQQNS

SEQ ID NO: 347 - protein, 561 aa, Bacillus cereus ATCC 10876
MIHLKKQYTVSTYLLDRLHELGIEHIFGVPGDYNLAFLDDVIAHKSLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAVEEIDRVLRACWNEKRPVHINLPIDVYNKPINKPTEPILYKPILSNKEALDKMLLHATSKIKNAKKPVILADFEVDRFHAKENLHQFVEKTGFPIATLSMGKGIFPEKHPQFIGVYTGDVSSPYLRKRIDESDCIISIGVKLTDTITGGFTQGFTKEQVIEIHPYTVKIIDKKYGPVVMQDVLQHLSDLIEHRNKNTLDIKPFILESSPFTEEFNPKAQMITQKRFWQHIYHFLQENDVLIVEQGTPFFGSAAIPLPNNTAYVGQPLWGSIGYTLPALLGTQLANLSRRNILIIGDGSFQVTAQELSTILRQNLKPIIFLINNNGYTVERAIHGQNQPYNDIQMWDYNKLSMIFGSEEKSLTFKVENEAELAETLANIIFNKNQLIFIEVIMSQSDQPELLAKLGKRFGQQNS

SEQ ID NO: 348 - protein, 561 aa, Bacillus cereus m1293
MIHLKTQYTVSTYLLDRLSELGIEHIFGVPGDYNLAFLDDVIAHENVEWIGNCNELNAAYAADGYARIKGIGALITTFGVGELSAINGIAGSYAENVPVIKITGTPTTKVMENGALVHHTLGDGKFDHFSKMYREITVAQTNLTPEHAAEEIDRVLRACWNEKRPVHINLPIDVYNKPINKPTEPILHKPILSNKETLDKMLLHAISKINSAKKPVILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSNVIEHRNEETFDIKPFISESLSITEKFNPKPQMVTQKRFWQQIYHFLQENDVLLAEQGTPFFGSAAIPLPNDTTYVAQPLWGSIGYTLPALLGTQLANLSRRNILIIGDGSFQLTVQELSTILRQNLNPIIFLINNNGYTVERAIHGQNEPYNDIQMWDYTKLANVFGTEEKSLTCTVENEIELQEVLTKISIDKDQLTFVEVVMSQGDQPELLAKLGKRFGQQNS

SEQ ID NO: 349 - protein, 550 aa, Citrobacter sp. 30_2
MQTPYSVADYLLDRLAGCGVGHLFGVPGDYNLQFLDRVIEHPDVCWVGCANELNAAYAADGYARVSGVGALLTTFGVGELSAINGIAGSFAEYVPVLHIVGAPCRGAQRRGELMHHTLGDGDFQHFYRMQQAVTTASAILDEQNACYEIDRVLRMMLSERRPGYLMLPADVAKQPATPPNDIMIVPLSEPESSVIEAFRYHARERLLDSPRVALLADFLALRFGLQPVLQRWMAETPMAHATLLMGKGLFDERHPAFVGTYSAGASSDYVRQAIEDADTIMCVGTQFVDTLTAGFTQQLPLDRTIDVQPHASRIGSHWFNIPMEQAVTTLRELCLEMSFSLPPERPPIRRVQVEKGPLTQENFWHTVQQFLKPDDIILVDQGTAAFGAAALSLPCGAEVLVQPLWGSIGYALPAAFGAQTACPDRRVILIIGDGAAQLTIQELGSMLRDGQSPVILLLNNDGYTVERAIHGANQRYNDIAAWSWTSVPQAFSRECQAECWRVKQAVQLEEVLARLSHPQRLSLIEVVLPKADLPELLRTVTRALESRNGG

SEQ ID NO: 350 - protein, 551 aa, Corynebacterium kroppenstedtii DSM 44385
MYTVADYIADRLAELHIKDVFGVPGDFNLEFLDHITGHDALHWVGNANELNAGYAADGYARMNGIGAVVTTFGVGELSAINAIAGSFSENVPVVHIVGAPSKDAQASRRLLHHSLGDGDFSHFRRMASEVTCAVADLTPADAVDEVDRVLRAVQTHRRPGYIVVPTDVARVEVEPPSSPLGGARSYTSDRALAEFRAAASEFLEGRDVTVLADLLVHRMGATENLNRLLSGGIPHATLMWGKTLVNEEDPFFLGVYAGAASEPDVRKAVEGADRLVMAGVRFTDTTTASFSQKIDPARCVDIATNYAKVGDKTFAPLNIADALDALAELAPSFADRAPGAVPEPEPHHWVADADGPLVQDDVWPTLAGVLTEGNIVVADQGTSFFGLAKMRFPADTTFIGQPLWGSIGYTLPAAMGAGLACPGRRPVLVIGDGSAQLTVQELGTWMREGVNGVVIVVNNDGYAVERSIHGEDAEYNDITAWDWRVIPQALGGTDDKVVTLKATTRTELNDAFEKAQDNQDRLVLIEVCTAPKDYPKLLKKIGKAINDANSK

SEQ ID NO: 351 - protein, 557 aa, Yersinia rohdei ATCC 43380
MGMIMASGYKVADYLLDRLAQIGIRHLFGVPGDFNLYFLDHVISHPVIQWIGCANELNAAYAADGYARVMPASALLTTVGVGELSAINGVAGSYAEYLPVIHIVGTPALRSQQAGELLHHSLGDGDFGHFSRMAKEITCAQASLTPENAAAEIDRLLVAALYQRRPVYLQLPSDVSEAEIATHSGSLALCQPMLSPTSLQAFIDAAREKLQPARRVAVLADFLAERFGARESLNRWLAEVNLPHSTLLLGKGLLDEAHPMFIGTYSGAASDSQVKEYIEDADVLITVGVWFVDTITAGFSQHITQDNCIDIQPEQVRIGRKVFSQIPMVAAVQALHKLCKSLKNEWQPPVITYSPPKTPTYNLLDQNAFWYHIQHFLRPNDVVVTDQGTSCFGAATLKLPSGCIFIAQSLWGSIGFSLPAAYGAQLAQPQRRMILLVGDGAAQLTIQELGSMLRDGLNPIIFLLNNHGYTVERVIHGPQQRYNDIAAWNWPQLPSALGLEKPAFTCTVTQVEQLQQVLAQVENIAQLAFIEVVLPPMDTPELLKNVAKSLQIRNAAL

SEQ ID NO: 352 - protein, 553 aa, Yersinia aldovae ATCC 35236
MSGSYKVADYLLDRLAQVGIRHLFGVPGDFNLQFLDSVISHPVIQWMGCANELNASYAADGYARVMPAAALLTTAGVGELSAINGIAGSFAEYLPVVHIIGTPALRSQKAGELLHHSLGDGDFSHFSRMAKEVTCAQTSLTADNAAAEIDRLLAAALSQRRPVYLQLPSDVAEAAVSAPSGVLALAQPMLSLTSLQAFIEAARVKLQSAHRVALLADFLASRFGAQQPLQLLLAEVDIPHSTLMMGKGLLDETHPMFIGTYAGAASDAFVKEYIEEADVLITVGVWFVDTITAGFSQNILRDKGIDIQPEQVRIGNTIFSQIPMAAAVSALHQLGKALQSEWQQPRVTRLLPVSLPDNPLNQHAFWYHIQHFLRAGDIVITDQGTSSFGAATLSLPADCIFISQSLWGSIGFSLPAAYGVQAALPERRVILIVGDGAAQLTIQELGSLLRDGLKPVIFLLNNQGYTVERAIHGPQQPYNDIAVWDWSQIPRVFGMRNAILTRSVTEVDQLQQVLEQLEECDQLAFIEVVLPPMDVPELLANVAKSIQARNAAI

SEQ ID NO: 353 - protein, 561 aa, Yersinia kristensenii ATCC 33638
MIVMSSNYKVADYLLDRLAQVGIRHLFGVPGDFTLHFLDHVISHPGIEWMGCANELNAAYAADGYARVMPAAALLTTVGVGELSAINGIAGSYAEYLPVIHIVGTPALRAQKAGELLHHSFGDGDFSHFSRMAKEVSCAQTSLTAENAVTEIDRLLVAALYQRRPVYLQLPSDVAQTDVVTHPEALALSQPILSPSSLQAFIAAAREKLQSAHRVALLADFLADRFGARQSLNNWLAAVNLPHSTLLMGKGLLDETHPLFLGTYAGAVSDIKVKECIENADVLVMVGVWFVDTITAGFSQHIIQDNCIDIQPEQVCIGRKVFSQIPMVTAVEALHTLCQSLQNEWQQPVITHPSTTLPTSEIVPHGWLNQQAFWSHIQSFLRPGDIVVTDQGTSCFGAASLKLPSGCTFIAQSLWGSIGFSLPAAYGAQLAQPQRRVILLVGDGAAQLTIQELGSMLRDGLTPIIFLLNNQGYTVERAIHGPQQRYNDIAEWDWTQLPQALALNKPSFSRRVTQVDQLQQVLAELENCQQLAFIEVVLPQMDAPELLINIAKSLQTRNAAV

SEQ ID NO: 354 - protein, 553 aa, Yersinia mollaretii ATCC 43969
MASSYKVADYLLDRLAQVGIRHLFGVPGDFNLHFLDHVISHPVIEWMGCANELNAAYAADGYARVMPAGALLTTVGVGELSAINGIAGSFAEYLPVIHIVGTPALRSQKAGELLHHSLGDGDFSHFSRMAKEVTCAQASLTAENAAAEIDRLLVAALNQRRPVYLQLPSDVAEADMATNSGTLALSPPLLSPTSLQAFIDAAREKLQSAHRVALLADFLADRFGARQSLNQWLAEVNLPHSTLLLGKGVLDETHPLFIGTYAGAASDASVKEVIENADVLITVGVWYVDTITAGFSQHITQDNCIDVQPEQVRIGSRVFSQIPMVAAVDALHQLCKSLQGEWPQPVITPPVRQASQHHLLSQQTFWYHIQHFLRPNDIVVTDQGTSSFGAATLNLPSGCTFIAQSLWGSIGFSLPAAYGAQLAQPQRRLILLVGDGAAQLTIQELGSMLRDGLNPTIFLLNNQGYTVERAIHGAQQRYNDIAPWNWTQLPQALTVGKQFMTRKIKETHQLQQVLAQIEGAQQLVFIEVVLPPMDMPDLLISVAKSIQARNSAT

SEQ ID NO: 355 - protein, 553 aa, Klebsiella pneumoniae NTUH-K2044
MQPTYTIGDYLLDRLVDCGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFCEHASRLLRGSRRISLLADFLAQRYGLQKTLREWVAKTPVAHATMLMGKGLFDEQQSGFVGTYSGIASAPQTREAIENADTIICIGTRFTDTITAGFTQHLAREKTIEIQPFAVRVGDHWFSGVPMDKALAALMTLSAPLAAEWATPQVVAPEAEEGAEGELTQKNFWATVQGALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVASRCRRVTQTSELREAMTESITSDTLTLVEVMLPKMDIPDFLRAVTQALEERNSRV

SEQ ID NO: 356 - protein, 550 aa, Salmonella enterica subsp. enterica serovar Tennessee str. CDC07-0191
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMFAARRPGYIMLPADVAKKTAIPPTQALTLPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 357 - protein, 573 aa, Acinetobacter baumannii AB900
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSDRPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPLLEKQPQKVIEAPAQQKLSQDVLWNYISGFLKEDDVIIGEVGTSNSALSGIKLPASAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPVKCKDAISF

SEQ ID NO: 358 - protein, 546 aa, Staphylococcus warneri L37603
MKQRVGQYLMDAVNAAGVDKIFGVPGDFNLAFLDDIISHDQVEWIGNTNELNASYAADGYARINGLGALVITFGVGELSAVNGIAGSYAERVPVIAITGAPTRAVESAGKYVHHSLGEGTFDDYRKMFEPITTAQGYITPENATTEIPRLIQAAINERRPVHLHLPIDVSMTEIDVAKPFQPETRDDQDVSRYIQMIEDKLHSAKQPVIITGHEINSFGLHSELEQFVNQTHIPVAQLSLGKGAFNEENEHYLGIFDGSIAEENVKNYVNQSDAILNIGAKLTDSATAGFSFEFDIDDVVMINHNYFKMNETITEQVALPHLLNGLMTISYKNKSEFPKYQRPQGENYQIDHEPLTQATYFKMMQDFLQLDDILIAEQGSSFFGAYDLALYKDNTFIGQPLWGSIGYTLPATLGTEIAAPHRRNVLLIGDGSLQLTVQSLSTMIRQQLKPIIFVVNNDGYTVERLIHGMKEPYNDIHMWDYKALPAVFGGDNVVVHDVNTSHELKETFEKINANGDCMHFVEVKMAVEDAPAKLSDIAKAFASQNK

SEQ ID NO: 359 - protein, 549 aa, Staphylococcus epidermidis W23144
MKQRVGQYLMDAVYSAGADKVFGVPGDFNLAFLDDIIAHNHIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINAAIQQRRPVHIHLPIDVALTEIEVSKPFKAEVEPQKDVQSYINMVQDKLESATQPVIITGHEINSFHLHKELEQFVDQTQIPVVQLSLGKGAFNEENPYYMGIFDGSIAEQDIQDYVNQSDAILNIGAKLTDSATAGFSYQFDINDVIMLNHNEFKINDTCIEAFSLPNILNGLNKYIHYKNTNDFPQYERPQAHNYELSNQPLTQETYFNMMQDFLQQDDILIAEQGTSFFGAYDLALYKDNTFIGQPLWGSIGYTLPATLGTQIANPYRRNILLIGDGSLQLTVQSLSTMIRQHLNPVIFVINNDGYTVERMIHGMKEPYNDIRMWDYKSLPSVFGGDNVLVHDVNTSEELMLTFENIKSNSDRMHFVEVKMSVEDAPAKLSNIAKAFASQNKSS

SEQ ID NO: 360 - protein, 546 aa, Staphylococcus epidermidis M23864:W1; identical to SEQ ID NO: 54

SEQ ID NO: 361 - protein, 549 aa, Staphylococcus epidermidis BCM-HMP0060
MKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLELASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 362 - protein, 555 aa, Pectobacterium carotovorum subsp. carotovorum PC1
MNENYTVGDYLLDRLAQIGIQHLFGVPGDYNLHFLDHVISHPEVTWVGCANELNAAYAADGYARCRPAAALLTTFGVGELSAINGIAGSYAEFLPVIHIAVAPSLASQRNGELLHHTLGDGDFSHFFHMAAEVTAAQASLTVENAATEIDRVIREALSQHKPVYLFLPLDVAAAPVGAQPHPLTLPEPLCSDDSLQAFITAATAMLSKANTVSLLADFLAQRMGVAEQLQHWIDNTPFPHATLLMGKGTLNEQHRNFTGTYSGGGSDEAIRAHIEDADVIISVGVRYTDTITTGFSHQIACEKNIDIQPTLARVGSQVFPSIPMSDAIAALENITATLASRWDHRTITAPALPQSEQKDTLNQCEFWQQIQHFLRPGDILVTDQGTSCFGAATLRLPKDCQFIVQSLWGSIGYSLPAAFGAQIAEPNRRVVLLIGDGSLQLTVQELGSIIRDRLNMVIVVMNNEGYTVERAIHGPEQRYNDIAAWNWTQLPAALGANENEILCEQVCSPTALAQTLKQVNAESRLSLIEVVLPKMDIPALLHTITQSLETRNTVQ

SEQ ID NO: 363 - protein, 546 aa, Staphylococcus aureus subsp. aureus USA300_TCH959
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQGGKYVHHSLGEGTFDDYRKMFAHITVAQGYITPENATTEIPRLINTAIAERRPVHLHLPIDVAISEIEIPTPFEVTATKDTDASTYIELLASKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYGPYNEIHMWDYKALPAVFGGKNVEIHDVESSKDLQDTFNAINGHPDVMHFVEVKMSVEDAPKKLIDIAKAFSQQNK

SEQ ID NO: 364 - protein, 546 aa, Staphylococcus aureus subsp. aureus TCH130
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEHAGKYVHHSLGEGTFDDYRKMFAHITVAQGYITPENATTEIPRLINTAIAERRPVHLHLPIDVAISEIEIPTPFEVTAAKDTDASTYIELLTSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNSATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 365 - protein, 561 aa, Mycobacterium avium subsp. avium ATCC 25291
MTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTDAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALTAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNALGVTDHLAFRVQTYGELDDALTAAARHQDRMVLVEVVLPRLEIPRLLVELVRPTSPDGSPRR

SEQ ID NO: 366 - protein, 571 aa, Mycobacterium intracellulare ATCC 13950
MDSAERTVVPVTDAATDPAYTVGDYLLDRLAELGVSEIFGVPGDYNLEFLDHIIAHPSLRWVGNANELNAGYAADGYGRLRGMSALVTTFGVGELSAANAIAGSYAEQVPVVHIVGGPSKDAQGTRRALHHSLGDGDFEHFFRVSREITCAQANLMPATARREIDRVLCEVREQKRPGYILLSTDVARFPTEPPEAPLPRYSGGTSPRALAMFVEAATELIGGHRLTVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGAALEALATILARRGTASPPVASPPAAPLPPPPPRDQPLTQKMLWDRVCRALTPGNVVLADQGTSFYGMADHRLPHGVTFIGQPLWGSIGYTLPAALGAAVAHPDRRTVLLIGDGAAQLTVQELGTFSREGLSPVIVVVNNDGYTVERAIHGETAPYNDIVSWKWTDVPHALGVTDHLAFRVQTYGELDDALTAAAEHKDRMVFVEVVLPRLEIPHLLVELVQPTSPDGSPRR

SEQ ID NO: 367 - protein, 573 aa, Acinetobacter radioresistens SK82
MFMEIGNFLNKRLSELGIKHIFGVPGDFNLSYLEQIETDSKIEFIGNCNELNAAYAADGYARINGFSALATTYGVGDLSAINGIAGAYTENVPLIHISGIPPLHAVTQGALIHHTLVDGNYDNIMNCMREFTVAQTRLTPANAASEIDRVLRQCALERRPVHIQLPSDITHVKIQIDDQPLCLERPVSDPEILEQAVDELFKCLSQAKKPALLIDNEADIFNVTTLLAELSAKTGISYACLPTAKNIMDESSPHYAGVYVGAASQLSVRNLIECSDCLIGIGARFTDIGTGMFSHKINKDSYIEIKRYEVNTARKNFPGIEIGELLTALNLRVTAKKSLKPTLETPATERIQVSEHQKLSHEILWKYIGNFFKADDVILGEVGTSNTALSGLRLPVTAKYICQPIWGSIGYTLPALLGSLLAAPKRRQILFIGDGSLQLTVQELSTIIRYGLKPIIFVLNNGGYTIERLILGENASYNDIQNWKYTELVQVFNGKEKYQTCMVETAGQLKNALDQVGAYDGLSLIELKLPAMDAPVSLLKFADVVARYDYGNFGYQKLKTEQHYVECKNAISF

SEQ ID NO: 368 - protein, 546 aa, Staphylococcus aureus A9635
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTTAKDTDASTYIELLASKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLQQLTDISYTNNASFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNAINGHPDVMHFVEVKMSVEDAPKKLIDIAKAFSQQNK

SEQ ID NO: 369 - protein, 549 aa, Pantoea sp. At-9b
MKTLKVGEYLLMRLQQAGVRHLFGVPGDYNLQFLDSVIAHPDITWVGCANELNAAYAADGYGRCNGAAALLTTFGVGELSAINGIAGSYAEYVPVIHIVGAPASEVQRQGDCVHHSLGDGDFRHFSRMAEEVSVASAVLTAANAAQEIDRVIGEALHQRRPGYLLLAVDVAQAEIALPLPAATTTTPPPSAVAAFALAAETLLASARQVALLADFLAARWQLQPQLAALRQLRSIPAATLLMGKGVLDEQQPGFVGTYAGEGSTPAVRAAIEDTDVTICVGVRFTDTVTAGFTQQLPAEKLIDLQPFHAVVAGATFAPLTMAEALEALLPLFRRYGEHWATANALEWQQTPDAKAFLSQHTFWQAMQHFLRPGDIILADQGTAAFGAAALRLPHDAQLLVQPLWGSIGYTLPAAFGAQTAQPDRRVILIIGDGSAQLTIQELGSMQRDGQQPIIFLLNNEGYTVERAIHGAHQRYNDIAQWNWTALPQALSLTGEAQSWRVSETQQLEAVMARLAQNQRLALVEVVLDKDDIPPLLRKVTASLHQRNGG

SEQ ID NO: 370 - protein, 554 aa, Nakamurella multipartita DSM 44233
MQTYTVADHLVDRLAELGIDRVFGVPGDYSLALLDHIVHHPSVAWTGTTNELNAGYAADGYARLRGMAALCTTFGVGELSAINAMAGSYAEHVPVVHVVGAPALVKQAQHRPVHHTLGDGEFGHFTAMHADITCARASLTEVNAVAEIDRVLTAVREQRLPGYLVVPADVAEAPVPRATAPLAPSADGTDPEALAAFTDAARALLDRAATRAEIGVLAGLLVHRFGAAGPLTDVLAAGVPHAVTPWAKSLVDESAPGFAGTYSGAAGSTETTRRAVEDAAALILAGVQFTDLNSGLFTQRITRSRTIDLGPRVACVGAATFAPIELADALAALAPLVADRPAADLAAAPPLDPEPPAPDGDPLTQATLWQEVADHLRAGDIVLADQGTSFYGMAPHPIPSGVTFVGQPLWASIGYTLPALVGACTAAPGRRGVLLVGDGAAQMTVTELSTVPRLGLRAVVLVVDNDGYTVERAIHGPDEPYNDIARWDWTALPAAFGAAGATAVRVETVGALRAALAAVPTRAAGLTLIQAVVPRDDVPDLLATLTRVLGGKTR

SEQ ID NO: 371 - protein, 550 aa, Erwinia pyrifoliae Ep1/96
MTTYTVGDYLLTRLNQIGIGHLFGVPGDYNLRFLDHVIDHPDLVWVGCANELNAAYAADGYARCRGAGALLTTFGVGELSAINGVAGSSAEYLPVIHIVGAPSQTSQNKGELLHHTLGDGDFGHFFRMQQEISVASSVLTPGNAAAEIDRVLIEALTKRRPVYLLLATNVAESPLSPPSSPLQLRLDCDKAQLAAFVDAAESLLAAARSVAMLADFLADRAQQQHRLQRWLEEIPMPYATLLMGKSVLPEMLFGFAGTYAGASSADSTRAVIENSDVLISVGVKYTDSITAGFTQQITRSKNIDVGLHASSVAGRQFEPVPMAAALEALHQLALKYGQGWQHGIVAPPVSEQQPSDSLTQNTFWHALQDFLRPGDIVLADQGTAAFGAAALRLPQDVRLLVQPLWGSIGYTLPAAFGAQTALPQQRVVLIIGDGSAQLTVQELGSMLRDGQHPVVFLLNNDGYTVERAIHGAQQRYNDIARWDWTRLPQTLGVDSQPQSWRVTQTVQLREVMKLLEEARQLSLVEVVLPKLDVPPLLASVSRALNQRNNS

SEQ ID NO: 372 - protein, 573 aa, Acinetobacter sp. RUH2624; identical to SEQ ID NO: 49

SEQ ID NO: 373 - protein, 573 aa, Acinetobacter baumannii ATCC 19606
MFIEIGEFLNLRLKQMGIQHLFGVPGDFNLSYLEQVEADPQLEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAASEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSSIPLLEKQPQKLIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLTFIELKLPAMDAPVSLKKFASVIARFDYGDRGYEILKERSQPVKCKDAISF

SEQ ID NO: 374 - protein, 555 aa, Cronobacter turicensis z3032
MPANYCIADYLLDRLAGCGVKHLFGVPGDYNLLFLDNVIAHPRITWVGCANELNGAYAADGYARCNGIGALLTTYGVGELSALNAVAGSYAEAVPVLHIVGAPCQSAQRKGEVLHHTLGDGDFHHFLRIAREVTAAQGWLTPANACSEIDRVIAEMLRTRRPGYLVLPTDVARAPATAPVNAITAPRPQGDDAQLAAFREAAQARFAKGGRVALLADFLAQRFGVQNALHQWMDDTPMPHSSLLMGKGVLDETKPGFTGTYSGAASDPAVCRAIEEAELVICVGVQFADTITAGFTQRLTRDQTIDVQPWATRVGDRWFSGIAMDQAVAILHDITKRHSARLAPPDATPPAIKSTAAGALNQQNFWPLIEAFLQPGDIIAVDQGTAAFGAAALRLPAGCDFLVQPLWGSIGYALPAAFGAQTACPNRRVVLITGDGAAQLSIQEMGSMLRDGQAPVVMVLNNDGYTVERAIHGATQRYNDIAPWQWTKLPHALHAASQAQSWRVSDAAQLKDVLERLSRPERLSLIEVMLPRDDVPPLLDAVSRALEARNGAQDE

SEQ ID NO: 375 - protein, 552 aa, Enterobacter cancerogenus ATCC 35316
MTTPYCVADYLLDRLTDCGADHLFGVPGDYNLQFLDHVIDSPDICWVGCANELNASYAADGYARCKGFAALLTTFGVGELSAMNGIAGSFAEYVPVLHIVGAPGMASQQRGELLHHTLGDGEFRHFYHMSEPITVAQAILTEQNACYEIDRVLTTMLRERRPGYLMLPADVAKKAATPPVNALTMRATEGDDACLQAFRDAAQQRLAATRRTALLADFLVLRHGLKQALQKWVNEVPMAHATMLMGKGIFDERQAGFYGTYSGSASAAAVKEAIEGADTVLCIGTRFTDTLTAGFTHQLTPAQTIEVQPHASRVGDVWYTGITMQQAIETLTQLCKQHVHHARISGDAHRDAHSVQTGSLTQENFWSTLQTFIRPGDIILADQGTSAFGAIDLRLPADVNFIVQPLWGSIGYTLAAAFGAQTACPNRRVIVLTGDGAAQLTIQELGSMLRDKQHPIVLVLNNEGYTVERAIHGPEQRYNDIALWNWTQIPQALSLDPQAECWRVSEAEQLAEVLDKVAHHERLALIEVMLPKADIPPLLAALTKALEARNSA

SEQ ID NO: 376 - protein, 558 aa, Klebsiella pneumoniae subsp. rhinoscleromatis ATCC 13884
MRIMDMQPTYTIGDYLLDRLVDCGIDRLFGVPGDYNLQFLDRVIAYSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFCEHASRLLRGSRRISLLADFLAQRYGLQKTLREWVAKTPVAHATMLMGKGLFDEQQSGFVGTYSGIASAPQTREAIENADTIICIGTRFTDTITAGFTQHLAREKTIEIQPFAVRVGDHWFSGVPMDKALAALMTLSAPLAAEWATPQVVAPEAEEGAEGELTQKNFWATVQGALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVASRCRRVTQTSELREAMTESITSDTLTLVEVMLPKMDIPDFLRAVTQALEERNSRV

SEQ ID NO: 377 - protein, 573 aa, Acinetobacter calcoaceticus RUH2202
MFIEIGDFLNLRLKQMGIQHLFGVPGDFNLSYLEQVEADPELEFIGNCNELNAAYAADGYARINGFSALATTYGVGDLSAINGIAGAYAENVPLIHISGIPPLHAVQKGTLIHHTLVDGNYDNIMNCMKEFTVAQTRLTPANAAFEIDRVLRQCFLDRRPVHIQLPGDITHVKIEVSERPLDLSYPAVEPELLQTVVSKLCDIIANAQSPALLIDNEASVFGVTSLLNDLSQKCSIPFAGMNTAKNIMDEGSSRYIGTYVGGASQPHVKNIIEQSDCLIGIGARFTDVGSAVFTHQIATKNYIEIKSYGLNIFGQDFPGIEIGQLLVELNKKVAPRKATKPVLEKQPQKAFEAPAQQKLSQDVLWNYIAGFLKEDDVIIGEVGTSNSALSGLKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVHQNDQLTFIELKLPAMDAPVSLKKFASVIARFDYGDRGYEILKERSQPIKCKDASSF

SEQ ID NO: 378 - protein, 573 aa, Acinetobacter radioresistens SH164
MFMEIGNFLNKRLSELGIKHIFGVPGDFNLSYLEQIEADSKIEFIGNCNELNAAYAADGYARINGFSALATTYGVGDLSAINGIAGAYTENVPLIHISGIPPLHAVTQGALIHHTLVDGNYDNIMNCMREFTVAQTRLTPANAASEIDRVLRQCALERRPVHIQLPSDITHVKIQIDDQPLCLERPVSDPEILEQAVDELFKCLSQAKKPALLIDNEADIFNVTTLLAELSAKTGISYACLPTAKNIMDESSPHYAGVYVGAASQLSVRNLIECSDCLIGIGARFTDIGTGMFSHKINKDSYIEIKRYEVNTARKNFPGIEIGELLTALNLRVTAKKSLKPTLETPATERIQVSEHQKLSHEILWKYIGNFFKADDVILGEVGTSNTALSGLRLPVTAKYICQPIWGSIGYTLPALLGSLLAAPKRRQILFIGDGSLQLTVQELSTIIRYGLKPIIFVLNNGGYTIERLILGENASYNDIQNWKYTELVQVFNGKEKYQTCMVETAGQLKNALDQVGAYDGLSLIELKLPAMDAPVSLLKFADVVARYDYGNFGYQKLKTEQHYVECKNAISF

SEQ ID NO: 379 - protein, 576 aa, Serratia odorifera 4Rx13
MLDIFITYLILKTNNCNLLQVMIMSKSYKVADYLLDRLAQIGIRHFFGVPGDYNLQFLDHVIDHPQITWVGCANELNAAYAADGYARCKPAAALLTTFGVGELSAVNGIAGSYAEYLPVIHVVGTPALRAQRAGDLLHHSLGDGDFGHFARMAKEVTVAQANLTAVNAEAEIDRLLTTALFERRPVYLMLPSDVAEAPLASRPAPLMLRQAHLSQASLQAFIAAAREMLLPARRVSLLADFLAERFGAERVLEQWMNEVDMPHSTLLLGKSVLDETHACFTGTYAGAASDPQVKQLIENADAVITVGVRFTDTITAGFSHHLPAEKCIDIQPFEARVGQQVFSQIPMRDAVKALHQLTLSQALQWQLPVIKRPALPEPNGSGLDQHGFWQQIQGFLRPGDIVIAEQGTACFGAAALSLPQGCRFIVQSLWGSIGYTLPAAFGAQTAEPARRVVLLIGDGSAQLTAQEIGSMLRDGLKPVIFLLNNEGYTVERAIHGPEQRYNDITQWNWTQLPQALAGEHQVKTLRVTEPEQLRQALREVGDSQQLAFVEVVLPKMDIPELLDTVSRAIQSRNAAA

SEQ ID NO: 380 - protein, 558 aa, Serratia odorifera 4Rx13
MKITIGAFILQQLRTLSIDRIYGVPGDYNLALLELIEQQGELEFIGNCNELNASYAADGYARLKGAGALITTYGVGDLAALSGIAGAYAESAPVICLSGTPPLHAMKNHELLHHTLADGNFDNVMNCFKQFTVAQALITPENAAVEIPRVISRAWTEKKPVYLQLPSDICDVEIEIAQTIAPPQLPQSDQYNVQLAAMALLARIKQAKKPIILVDQMVDRFQLQQLVVDVAHKFAIPLTNMPTAKCIIPETTAGWMGGYSGDLSRPELYEHMANADCVLTFGVRLVDSTTGYFSHRIPAGSQIDIQPFSLKLGKTSYPAVAAADLLQALLALDKGMAAPPLAPLPEHKHRLATPGEAALDQDYFWQRMQRFIRADDVLVVENGTSGAAIGGMRMPDGVKVVNQPIWGSIGYTLPALLGTLMAAPHRRHLLFIGDGSFQLTAQEVSTLLRYEQKPIIFLINNDGYTIERYILGENSSYNDIGPWDYAKLPAVLNTQATPFSVAVETTQQLELALEQASRQDRLAFIEVKVPMMDTPPVMKEFCNRCNNFNFGLTNPRRA

SEQ ID NO: 381 - protein, 549 aa, Staphylococcus epidermidis ATCC 12228
MKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 382 - protein, 548 aa, Lactococcus lactis subsp. lactis KF147
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLENTVTQFISKTKLPITTLNFGKSSVDETLPSFLGIYNGKLSEPNLKEFVESADFILMLGVKLTDSSTGAFTHHLNENKMISLNIDEGKIFNESIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQELGLAIREKINPICFIINNDGYTVEREIHGPNQSYNDIPMWNYSKLPESFGATEERVVSKIVRTENEFVSVMKEAQADPNRMYWIELVLAKEDAPKVLKKMGKLFAEQNKS

SEQ ID NO: 383 - protein, 546 aa, Staphylococcus aureus subsp. aureus D139
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPRPFEVTAAKDTDASTYIELLASKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLQQLTDISYTNNASFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 384 - protein, 546 aa, Staphylococcus aureus subsp. aureus ST398
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTAAKDTDASTYIELLASKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLKQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGENVEIHDVESSKDLQDTFNAINGHPDVMHFVEVKMSVEDAPKKLIDIAKAFSQQNK

SEQ ID NO: 385 - protein, 546 aa, Staphylococcus aureus subsp. aureus H19
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGESTFDDYRKMFAHITVAQGYITPENATTEIPRLINTAIAERRPVHLHLPIDVAISEIEIPRPFEVTAAKDTDASTYIELLASKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLQQLTDISYTNNASFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 386 - protein, 551 aa, Citrobacter rodentium ICC168
MQTPYTVADYLLDRLAGCGIAHLFGVPGDYNLQFLDHVIDHPDVCWVGCANELNAAYAADGYARLAGAGALLTTFGVGELSALNGLAGSYAEYVPVLHIVGAPCSGAQRRGELMHHTLGDGDFSHFYRMSQAVCAASAVLDEQTACHEIDRVLHAMLTSRRPGYLLLPADVAKRPAVPPSEALVPLQPESQESVVTAFRYQARQMLMNSPRVALLADFLARRFDLQPVLQRWMAETPMAHATLLMGKGLFDEQQPGFVGTYSGGASGEFVREAIEGADTTICVGTRFVDTLTAGFTQQLAAERTIEVQPHGSRIGQTWYSGISMEQAVVTLREVCLELSFAPPPAKPAGEQTQVKQGALNQQNFWHTVQQALQPGDVILADQGTAAFGAASLTLPAGAELLVQPLWGSIGYALPAAFGAQTAAPGRRVILITGDGAAQLTIQEMGSMLRDGQSPVILLLNNDGYTVERAIHGETQRYNDIARWNWTQIPHALNLAGRAECWRVTQAVQLAEVLARLTRPERLSLIEVVLPQADLPVLLRAVTRALETRNSG

SEQ ID NO: 387 - protein, 550 aa, Citrobacter youngae ATCC 29220
MQTPYSVADYLLDRLADCGVDHLFGVPGDYNLQFLDHVIEHPSVRWVGCANELNAAYAADGYARVAGAGALLTTFGVGELSAINGIAGSYAEYVPVLHIVGAPCCGAQRRGELMHHTLGDGDFQHFYRMQQAVTTASAVLDEQNACYEIDRVLRAMLTERRPGYLMLPADVAKQPATPPNDPLIVSQSEPASSVAAAFRYHARERLLDSPRVALLADFLALRFGLQPVLQRWMAETPMAHATLLMGKGLFDERHPAFVGTYSAGASSDYVRQAIEEADTIMCVGTQFVDTLTAGFTQRLPPERTIEVQPHASRVGSQWFNVPMEQAVTTLRELCLEMSFSLPPERPPVERIQIEKGLLTQENFWHTVQHYLAPDDIILVDQGTAAFGAAALSLPSGAEVLVQPLWGSIGYTLPAAFGAQTACPDRRVILIIGDGAAQLTIQELGSMLRDGQSPVILLLNNDGYTVERAIHGANQRYNDIAGWNWTQVPQALSRECQAECWRVKQAVQLEEVLARLSHPQRLSLIEVVLPKADLPELLRTVTRALESRNGG

SEQ ID NO: 388 - protein, 553 aa, Klebsiella variicola At-22
MQPTYTIGDYLLDRLVDCGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQGLLVEPAPADENQLAGFREHASRLLRGSRRISLLADFLAQRYGLQNTLREWVAKTPIAHATMLMGKGLFDEQLSGFVGTYSGIASAPQTREAIENADTIICIGTRFTDTITAGFTQHLSREKTIEIQPFAVRVGDHWFSGVPMDQALAALMTLSAPLAAEWAAPQVMAPEVEEEGEGELTQKNFWSTVQDALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVVSRCWRVTHTAELREAMAESITSDTLTLVEVMLPKMDIPDFLRAVTQALEERNSRV

SEQ ID NO: 389 - protein, 546 aa, Staphylococcus lugdunensis HKU09-01
MKQRVGQYLMDAIYQAGADRVFGVPGDFNLAFLDDIVAHEHLQWVGNTNELNASYAADGYARLKGVSALVTTFGVGELSAVNGIAGSYAERVPVIAITGAPTRAVEQAKKYVHHSLGEGTFDDYQKMFSHITTAQGYITPENATTEIPRLINASLQERRPVHIHLPIDVAMTEIEVTEPFKLQNPKQHDVSEYIKLIQQKLQSASNPVIIAGHEINSFHLHDALEQLVNQTNIPVAQLSLGKGAFNEENPHYLGIFDGKFAEDNVRDYVNNSDAILNIGAKLTDSATGGFSYDFDIEDVVMINHHNFKLGDTQNNEVSLPDMLHGLLEMDYHNKGTYSSYVRPKAHSYTLSDEPLTQETYFNMIQDFLQPDDVLLAEQGTSFFGAYDLALYKNVDFIGQPLWGSIGYTLPATIGSQMADTTRRNILLIGDGSLQLTVQGLSTMIRNQLKPIIFVINNDGYTVERLIHGMKAPYNDIHMWDYKALPAVFGGDNVAIHDVHTSNDLKRTFDEINAESDVMHYVEVTMAAEDAPEKLANIAEAFASQNK

SEQ ID NO: 390 - protein, 553 aa, Klebsiella sp. 1_1_55
MQPTYTIGDYLLDRLVDSGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQGLLVEPAPADENQLAGFREHASRLLRGSRRISLLADFLAQRYGLQNTLREWVAKTPIAHATMLMGKGLFDEQLSGFVGTYSGIASAPQTREAIENADTIICIGTRFTDTITAGFTQHLAREKTIEIQPFAVRVGDHWFSGVPMDQALAALMTLSAPLAAEWAAPQVMAPEVEEEGEGELTQKNFWSTVQDALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVVSRCWRVTHTAELREAMAESITSDTLTLVEVMLPKMDIPDFLRAVTQALEERNSRV

SEQ ID NO: 391 - protein, 574 aa, Pantoea ananatis LMG 20103
MLPFSPNFRHVRYLSEQSPSKEFAMSDFTVGDYLLARLQECGVRHLFGVPGDYNLQFLDRVIAHPDIGWVGCANELNAAYAADGYTRCTGAAALLTTFGVGELSAINGLAGSFAEYLPVIHIVGAPSSQAMQQGDCVHHTLGDGDFGHFIRMAKEVSAATAALTADNATAEIDRVILTALQQHRPGYLMLPVDVAQRQTSAPDQPLMPTTASSDEVRIAFQQAAERLLAPAKRVSLLADFLAQRWQQQPALAALRTGRAFPCATLLMGKGVLDEQQPGFVGTYAGEGSEGDVRQQIEEVDVTICAGVRFTDTITAGFTQQFSQARLIDIQPHSASVAGQTFAPLSMAEALQALLPVFERLGAGWQAACAPRAAEPVSDAALISQSAFWQAMQGFLQPGDIILADQGTAAFGAASLRLPVGAQLLVQPLWGSIGYTLPAAFGAQTARPGQRVILIIGDGSAQLTIQELGSMLRDQQHPLIFLLNNEGYTVERAIHGAAQRYNDIAQWNWTALPQAMSLECQAQSWRISETVQLQALMAQLTQQRRLSFIEVVMQKDDLPPLLRKVSACLSQRNGG

SEQ ID NO: 392 - protein, 550 aa, Erwinia amylovora CFBP1430; identical to SEQ ID NO: 46

SEQ ID NO: 393 - protein, 559 aa, Serratia odorifera DSM 4582
MKVTIGQFILQQLRALNIDHIYGVPGDYNLSLLELIEHDNQLQFIGNCNELNASYAADGYARMKGAGALITTYGVGDLAALSGIAGAYAESSPVICLAGTPPLHAMKSHALMHHSLADGNFDNVMNCFKQFTVAQALITPENAAVEIPRVLAVAWTEKKPVYLQLPSDICEVEIEVTSAVVAPRLPASDRYNLQLAASALLRRLQQAQRPVMLIDQMVDRYQLQQLVVEVAHKFAIPLTNMPTAKCIIAETTAGWMGGYSGNLSRPELFALMANSDCVLNFGARLVDSTTGYFSHQIPTAGQIDIQPYTVKLDNVAYPAVAAADLLQALLDGAAGDAATPMATLPNPRHKLAAPSDAPLDQAYFWQRMSRFIAEDDVLVVENGTSGAAIGGMRMPDGVKVVNQPIWGSIGYTLPALLGTLMAAPERRQILFIGDGSFQLTAQEVSTLLRYEQKPIIFLINNDGYTIERYILGEASSYNDIGRWDYAALPAVLNTEARPFCAAVETGQQLELALEHASRQDRLAFIEVKLPMMDTPPVMKEFCNRCNNFNFGLRNPRRCA

SEQ ID NO: 394 - protein, 553 aa, Serratia odorifera DSM 4582
MSKNYTVANYLLDRLAQMGIRHLFGVPGDYNLQFLDHVIDHPQVTWVGCANELNAAYAADGYARCKPAAAMLTTFGVGELSAINGVAGSYAEYLPVIHIVGAPTLRCQRSGELLHHSLGDGDFGHFARMAKEVTIAQASLTAANAEAEIDRLLTTALFERRPVYLLLPSDVAQAPLASRPAPLMLRQPNLSAASLQAFVKAARVQLQAAQRVSLLADFLADRFGAQQALSQWMQEVSIPHATLLMGKSVLDETHAAFTGTYAGAASAPPVKQLIEGADAIISIGVRLTDTITAGFSHSLPADKCIDIQPFEARVGQQVFSQIPMRDAVIALHQLTLPLCRHWTLPVIARTPLPQSHGGGLDQHGFWQQVQDFLRPGDIVLAEQGTASFGAAALTLPQGCHFIVQPLWGSIGYTLPAAFGVQTAEPERRVILLIGDGSAQLTAQELGSMLRDGQKPIVFLLNNDGYTVERAIHGPEQRYNDIAAWNWTLLPQAMGDGQRVKTLRVSEPESLRAALSEVNDCDRLAFIEVILPKMDIPELLDSVSRAIQVRNAAA

SEQ ID NO: 395 - protein, 573 aa, Acinetobacter sp. SH024
MFIEIGDFLNLRLKQMGIQHLFGVPGDFNLSYLEQVEADPQLEFIGNCNELNAAYAADGYARINGFSALATTYGVGDLSAINGIAGAYAENIPLIHISGIPPLHAVQKGTLIHHTLVDGNYDNIMNCMKEFTVAQTRLTPANAAFEIDRVLRQCFLERRPVHIQLPGDITHVKIEVSERPLDLSYPAVEPELLQSVVSKLCDIIENAQSPALLIDNEASVFGVTSLLNDLSQKCSIPFAGMNTAKNIMDEGSPRYIGTYVGGASQPHVKNIIEQSDCLIGVGARFTDVGSAVFTHQIETKNYIEIKSYGLNIFGQDFPGIEIGQLLVELNKKVAPRKSTIPLLEKQPSKVIEAPAQQKLSQDVLWNYISGFLKEDDVIIGEVGTSNSALSGIKLPATAKYIAQPLWGSIGYTLPALLGSLLAAPERRQILFIGDGSFQLTVQELSTIIRHGLKPIIFLLNNGGYTIERLIMGENAAYNDVQNWKYTEIPAVFNGKKGHTTYVVETAGQLKSVLDNVQQNDQLAFIELKLPAMDAPVSLKKFASVIARFDYGDRGYEILKERSQPIKCKDAISF

SEQ ID NO: 396 - protein, 552 aa, Enterobacter cloacae subsp. cloacae ATCC 13047
MRTPYCVADYLLDRLTDCGADHLFGVPGDYNLQFLDHVIDSPDICWVGCANELNASYAADGYARCKGFAALLTTFGVGELSAMNGMAGSFAEHVPVLHIVGAPGTASQQKGELLHHTLGDGEFRHFYHMSEPITVAQAILTEQNACYEIDRVLTTMLRERRPGYLMLPADVAKKSATPPVNALTLKTAHADNACLKAFRDAAESRLKTSKRTALLADFLVLRHGMKHALQKWVKEVPIAHATMLMGKGIFDERQPGFYGTYSGSASVGAVKEAIEGADTVLCIGTRFTDTLTAGFTHQLTQAQTIEVQPHAARVGDVWFTGIPMSDAIETLVALCKQYVHDTLAPVSHSGIAFPQSEGSLTQENFWSTLQTFIRPGDIILADQGTSAFGAIDLRLPADVNFIVQPLWGSIGYTLAAAYGAQTACPDRRVIVLTGDGAAQLTIQELGSMLRDKQHPIILVLNNEGYTVERAIHGPEQRYNDIALWNWTQIPQALSLDPQAQCWRVSEAEQLAEVLEKVAHHERLTLIEVMLPKADIPPLLGAITKALEARNNA

SEQ ID NO: 397 - protein, 552 aa, Enterobacter cloacae NCTC 9394
MRTPYCVADYLLDRLTDCGADHLFGVPGDYNLQFLDHVIDSPDICWVGCANELNASYAADGYARCKGFAALLTTFGVGELSAMNGVAGSFAEHVPVLHIVGAPGMAAQQRGELLHHTLGDGEFRHFYHMSEPITVAQAVLTEQNACYEIDRVLTTMLRERRPGYLMLPADVAKKVATPPVSALTVNPPPADSACLQAFREAAEKRLSTSKRTALLADFLVLRHGLRTALQTWVKEVPMAHATMLMGKGIFDERQSGFYGTYSGSASAAPVKEAIEGADTVLCIGTRFTDTLTAGFTHQLTPDQTIEVQPHASRVGDVWFTGIPMREAIETLTALCKTYVRDTRASLDHSGFSFPTIEGALTQESFWRTLQTFIRPGDIILADQGTSAFGAIDLRLPADVNFIVQPLWGSIGYTLAAAFGAQTACPNRRVIVLTGDGAAQLTIQELGSMLRDKQRPIILVLNNEGYTVERAIHGPEQRYNDIALWNWTQIPQALSLAPQAECWRVSEAEALAEVLDKVAHHERLSLIEVMLPKADIPPLLSALTKALEARNNA

SEQ ID NO: 398 - protein, 558 aa, Bacillus cereus ATCC 14579
MKKQYTVSTYLLDRLHELGIEHIFGVPGDYNLAFLDDVVAHENLKWIGNCNELNAAYAADGYARIKGIAALITTFGVGELSAINGIAGSYAENVPVIKITGTPPTKVMENGAIVHHTLGDGKFDHFSNMYREITVAQTNVTPEHAAEEIDRVLRACWNEKRPVHINLPIDVYNKPINKPTEPIINKPILSNKEALNKMLLHAISKINSAKKPVILADFEVDRFHAKENLHQFVEKTGFPIATLSMGKGIFPEKHPQFIGIYTGDVSSPYLRKRIDESDCIISIGVKLTDTITGGFTQGFTKEQVIEIHPYTVKIIDKKYGPVVMQDVLQHLSDSIEHRNKDTLDVKPFILESSPFTEEFIPKAQMVTQKRFWQQMYHFLQENDVLIVEQGTPFFGSSAIPLPNNTAYVGQPLWGSIGYTLPALLGTQLANLSRRNILIIGDGSFQVTAQELSTILRQNLKPIIFLINNNGYTVERAIHGQNQLYNDIQMWDYNKLSMVFGAEEKSLTFKVENEAELAAVLTNITFNKNQLIFIEVIMSQSDQPELLAKLGKRSGQQNS

SEQ ID NO: 399 - protein, 561 aa, Bacillus anthracis str. Ames
MIHLKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGIPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 400 - protein, 563 aa, Mycobacterium avium subsp. paratuberculosis K-10
MPVTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALTAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNALGVTEHLAFRVQTYGELDDALTAAARHQDRMVLVEVVLPRLEIPRLLVELVRPTSPDGSPRR

SEQ ID NO: 401 - protein, 561 aa, Bacillus cereus ATCC 10987
MIHLKTQYTVSTYLLDRLSELEIEHIFGVPGDYNLAFLDDVVAHEKLEWVGNCNELNAAYAADGYARIKGIAALITTFGVGELSAINGVAGSYAENVPVIKITGTPPTTVMENGALVHHTLGDGKFDHFSNMYREITVAQTNLTPEHAAEEIDRVLRACWSEKRPVHIQLPIDVYNKPINKPTESILHKPVVSNKDALDKMLLHATSKINSARKPVILADFEVARFHAEEYLHQFVEKTGFPIATLSMGKGIFPEKHPQFIGIYTGDVSPSYLRKRIDESDCIISIGVKLTDTITGGFTQGFKKEQVIEIHPYTVKIMDKKYGPVVMKDVLKQLNDLIEHRKEDTLEIKPFISESLPITEEFNPKAQMITQKRFWQQIYHFLQENDVLIAEQGTPFFGSATIPLPNNTTYVAQPLWGSIGYTLPALLGTQLANLSRRNILIIGDGSFQLTVQELSTILRKNLKPIIFLINNNGYTVERAIHGQNEPYNDIQMWDYTKLANVFGTEEKSLTWKVENETELAEVLMNITVNNNQLIFIEVVMSQGDQPELLANLGKRFGMQNS

SEQ ID NO: 402 - protein, 547 aa, Lactococcus lactis; identical to SEQ ID NO: 66

SEQ ID NO: 403 - protein, 561 aa, Bacillus cereus G9241
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDHVLRACWSAKRPVHIQLPIDVYNKPINKPTEPILHKPVVSNKDALDKMLLHATSKINSAKKPVILADFEVDRFHAKEYLYQFVEKTGFPIATLSMGKGIFPEKHSQFIGIYTGDVSSPYLRKRIDESDCIISIGVKLTDTITGGFTQDFTKEQVIEIHPYTVKIIDKKYGPVVMKDVLQQLSNVIEHRNEETLDIKPFISESLSITEKFNPKPQMVTQKRFWQQIYHFLQENDVLLAEQGTPFFGSAAIPLPNNTTYVVQPLWGSIGYTLPALLGTQLANVSRRNILITGDGSFQLTVQELSTILRQNLKPIIFLINNNGYTVERAIHGQNEPYNDIQMWDYTKLANVFGSKEKSLTCKVENEIELAEVLTDITLNNKQLTFIEVVMSQGDQPELLAKLGERFGKQNS

SEQ ID NO: 404 - protein, 561 aa, Bacillus thuringiensis serovar konkukian str. 97-27
MIHLKTHYTVSTYLLDRLSELGIEHIFGIPGDYNLAFLDDVIAHEKLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 405 - protein, 546 aa, Staphylococcus aureus subsp. aureus MRSA252
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENAATEIPRLINTAIAERRPVHLHLPIDVAISEIEIPTPFEVTAAKDTDASTYIELLVSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLSSLLQQLTDISYTNNASFPAYHRPTSPDYTVGTEPLTQQTYFKMMQNFLKPNDVIIADQGTSFFGDYDLALYKSNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQEVFNTINGHPDVMHFVEVKMSVEDAPKKLIDIAKAFSQQNK

SEQ ID NO: 406 - protein, 555 aa, Pectobacterium atrosepticum SCRI1043
MSENYTVGDYLLDRLTQIGIQHLFGVPGDYNLHFLDHVIRNPDITWVGCANELNAAYAADGYARCRPAAALLTTFGVGELSAINGIAGSYAECLPVIHIAAAPCLASQRNGELLHHTLGDGDFSHFSRMAAEVTVAQASLTVENATAEIDRVIGEALAQHKPVYLFLPVDVAAAPVGARPYPLVIPEPLHSDDSLRAFTTAATDMLSKAKSVSLLADFLAQRFSLAGKIQRWLDKTPLPHATLLMGKGTLNEQHRSFTGTYSGSGSHESIRAHIEDADAIISIGVRYTDTITTGFSHQIPIEKNIDIQPTLARVGNQVFPSVPMSDAIAVLEKITEKFASRWDHCTITPPVLPQSEHRSALSQREFWQQIQRFLRPDDILVTDQGTSCFGAATLRLPAGCHFIVQPLWGSIGYSLPAAFGAQIAEPERRVVLLIGDGSLQLTVQELGSIIRDRLNMVIVVLNNEGYTVERAIHGSEQRYNDIAAWNWTQLPTALGANENEILCKQVRSPIALAQVLEQVNAESRLSLIEVVLPRMDIPALLHTITQSLETRNTVQ

SEQ ID NO: 407 - protein, 548 aa, Lactococcus lactis subsp. lactis; identical to SEQ ID NO: 68

SEQ ID NO: 408 - protein, 561 aa, Bacillus cereus E33L
MIHLKTQYTVSTYLLDRLSELGIEHIFGVPGDYNLAFLDDVLAHKNLEWIGNCNELNAAYAADGYARIKGIGALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAEPILHKPILSNKETMDKMLLHAISKINSAKKPIILADFEVDRFHAKEYLYQFVEKTGFPIATLSMGKGIFPEKHPQFIGIYTGDVSFPYLRKRIDESDCIISIGVKLTDTITGGFTQGFTKEQVIEIHPYTVKITDKKYGPVVMKDVLQQLSDIIKHRNEETLDIKPFISESLSMTEEFNPKAHMVTQKRFWQQIYHFLQENDVLLAEQGTPFFGSAAIPLPNNTTYVAQPLWGSIGYTLPALLGTQLANLSRRNILIIGDGSFQLTVQELSTMLRQNLKPIIFLINNNGYTVERAIHGQNEPYNDIQMWEYTKLANVFGTEEKSQTFKVENETELQEVLTKISIDKDQLTFVEVVMSQGDQPELLAKLGKRFGQQNS

SEQ ID NO: 409 - protein, 550 aa, Salmonella enterica subsp. enterica serovar Paratyphi A str. ATCC 9150
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALTLPVHEAQSGVETAFRYHARQCLMNSRRIALLADFLAGRFGLRPLLQRWMAETPIAHATLLMEKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNGGYTVERAIHGAAQRYNDIASWNWTQIPPALNAAQQVECWRVAQAIQLAEVLERLARPQRLSFIEVMLPKADLPELLRTVTRALEARNGG

SEQ ID NO: 410 - protein, 546 aa, Staphylococcus aureus subsp. aureus COL
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQGGKYVHHSLGEGTFDDYRKMFAHITVAQGYITPENATTEIPRLINTAIAERRPVHLHLPIDVAISEIEIPTPFEVTATKYTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMAVEDAPKKLIDIAKAFSQQNK

SEQ ID NO: 411 - protein, 550 aa, Salmonella enterica subsp. enterica serovar Choleraesuis str. SC-B67
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPTERTLEIQPYALRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKAELPELLRTVTRALEARNGG

SEQ ID NO: 412 - protein, 546 aa, Staphylococcus haemolyticus JCSC1435
MKQRVGQYLMDAVHRAGVDKIFGVPGDFNLAFLDDIVRHNGVEWVGTTNELNGSYAADGYARINGLGVLVTTFGVGELSAVNGIAGSYAERVPVIAITGAPTQAVEQAGKYVHHSLGEGRFDSYQKMFEHITTAQAYITAENATTEIPRVINAAIHERRPVHIHLPIDVAMTEIEVDSEYDVAPTADVNVERYIDMVADKLRSASQPVIITGHEINSFHLHKALEQFVNQTHIPVAQLSLGKGAFNEENPYYIGIYDGKIAEDQIKDYVDNSDAILNIGAKLTDSATAGFSYEFDIDDVVMLNHHNFKLNETIAEDVTLPSLIDGLNTIDYRYEGSFPTFEKGSSKEVALSDDILTQSTYFDMMQHFIKDDDVLLAEQGTSFFGAYDLALPKDMTFIGQPLWGSIGYTLPATLGTQMANSNRRNILLIGDGSLQLTVQELSTMIRQDIKPIIFVINNDGYTVERLIHGMEETYNDIRMWDYKALPKVFGGDNVVVHDVKTSNDLQNVFDAINAAPEQLHFTEVTMKWDDAPAKLRDISKAFAAQNK

SEQ ID NO: 413 - protein, 547 aa, Staphylococcus saprophyticus subsp. saprophyticus ATCC 15305
MKKRVGQYLMDCISDVGVDKVFGVPGDFNLTFLDDIISRDDMEWIGNTNELNASYAADGYARMKGIAAMVTTFGVGELSAVNGIAGSYAERVPVIQITGAPTRAVESAGKYVHHSLGEGNFDDYRNMYASITTAQAYITPENAQSEIPRVINAALYEKRPVHIHLPIDVANSEIDVATPFEIEQRPQTDVTKYMTMVKDKLQSADKPVIITGHEINSFKLHEKLEQFVKQSQIPVVQLSLGKGAFNETSPYYMGIYDASLAEEDIRNYVDQSDAILNIGAKLTDSATAGYSYQFDIDDVVMINHHHFKMNETKDTEVSLVDLLDGLNAINYVNNAEFPKFKQPKAHDYDLTDEPLTQETYFKMMQDFIREEDVILAEQGTSFFGAYDLALKHNNKFIGQPLWGSIGYTLPATLGTQMADTSRRNLLLIGDGSLQLTVQEISTMIREKIKPIIFVINNDGYTVERKIHGENAMYNDIKMWDYKLLPTVFGGKDEVQVHDVNTSEAFQKVLLQIEAQPDTMHFIEVKMGVHDAPHKLNAIGQAFAKQNG

SEQ ID NO: 414 - protein, 546 aa, Staphylococcus aureus RF122
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEEAGKYVHHSLGEGTFDDYRKMFAHITVAQGYITPENATTEIPRLINTAIAERRPVHLHLPIDVAISEIEIPTPFEVTVAKDTDASIYIELLASKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLQQLTDISYTNNASFPAYHRPTSPDYTVGTESLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 415 - protein, 580 aa, Burkholderia xenovorans LB400
MRMQIGAFLARRLTEAGVRHLFGVPGDFNLSFLEQIQEADGIEFVGNCNELNAAYAADGYARTSGIAALVTTFGVGDLGAIGGIAGAYAENVPVVHITGTPPLHAVNSRALVHHTLVNGDYDNIGRCMSEFTVAQTRITPANAAFEIDRVLRSCWLERRPVHLQLPSDVTHVVVEVPEAPLMLADPSSDPHQLREATRRIVEALASARFPAIVVDADADRFGVTELVQKLAEKCSIPCASLTPAKSALNETSRHYVGTYVGAASAEPVRSIVENADCLIGVGLRFTDTSTALFSQHFNPEAFIDLRRHDLSLGTTQIPGVTLRDVLARVVDDAQPVVRERATQALAAASDALPASSGNVPLTHAALWPRIRRFLKPRDVILGEAGTSHASLSAMKLPPGATYIAQPIWGAIGYTLPALFGSLVGTPSRRHLLFIGDGSFQLTAQELSSILRRDLKPVIFLLNNSGYTIERLILGEHSAYNDVANWHYAGLPHAFDRRERALSLVVETVADLEAALNRAESAEHLVFIELKLPMMDAPESLKKFADIFADFDYGERGPRNPSKLVASEAPAHGHSLTDETA

SEQ ID NO: 416 - protein, 556 aa, Psychrobacter cryohalolentis K5
MSQQYTIADYLFDRVAEAGASEVFGVPGDFNLTFLDNVLASDKLRWVGNTNELNAGYAADGYARERGFAAMVTTFGVGELSAINATAGSFAEYAPVLHIVGAPSTALQDSKRRIHHSLGDGVFNHFIKMVEPVTVARAQITPENAASEIDRVIRVILKKHRPGYLLLSPDVAKTPIYPPTTKLIDSEEDITSQAALADFKQALIEFLPNKTTTLMADLMVHRLGLQNQLKALIADTDIPYTTLSWGKTLLDENSERWAGTYAGVASRPVVKDMVENCECLIKIGVQYTDTTTAGFSQDIDENVVVDLHYERASIAGKNFAPIALKDALKTLHEVMTSDINIVPKQFCEEVKQHEQHGKDNEAIRQDDLWHIIADALDDKNLVFSEQGTAYFGISDVRLPEGVTSYGQPMWGSIGYTLPASLGGAIASPHKRSILLIGDGSALLTIQEIAVMIQERINPVIVLINNDGYTVERAIHGENQYYNDIPKCDWQLMPKAFGANANNSLLLKAETAGELKDALKQAAAAKDKLVMLEVIAGKHDIPPLLADISAALKPKND

SEQ ID NO: 417 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

What is claimed is:

1. A method of converting α-ketoisovalerate to isobutyraldehyde comprising
   a. providing a polypeptide wherein said polypeptide comprises:
      (i) at least 80% identity to SEQ ID NO: 53, 56, 58, 59, or 63 or an active fragment thereof; and
      (ii) said polypeptide has α-ketoisovalerate decarboxylase activity, a specificity ratio for α-ketoisovalerate to pyruvate greater than 1, and thiamine diphosphate cofactor activation constant ($K_c$) of about 20 μM or less; and
   b. contacting said polypeptide with α-ketoisovalerate under conditions wherein isobutyraldehyde is produced.

2. The method of claim 1 wherein the contacting occurs within a recombinant host cell and wherein the polypeptide is heterologous to recombinant host cell.

3. The method of claim 2 wherein the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Issatchenkia, Kluyveromyces, Yarrowia, Pichia, Candida, Hansenula*, or *Saccharomyces*.

4. The method of claim 2 wherein the recombinant host cell is *Saccharomyces cerevisiae*.

5. The method of any one of claims 2-4 wherein the recombinant host cell further comprises heterologous polynucleotides encoding polypeptides which catalyze the substrate to product conversions: (a) pyruvate to acetolactate; (b) acetolactate to 2,3-dihydroxyisovalerate; and (c) 2,3-dihydroxyisovalerate to 2-ketoisovalerate.

6. The method of claim 5 wherein the host cell further comprises a heterologous polynucleotide encoding a polypeptide which catalyzes the substrate to product conversion isobutyraldehyde to isobutanol.

7. The method of claim 5, wherein the recombinant host cell further comprises reduced or eliminated pyruvate decarboxylase activity.

8. A method of producing isobutanol comprising:
   a. providing a recombinant host cell comprising an isobutanol production pathway, the production pathway comprising a polypeptide wherein said polypeptide comprises:
      (i) at least 80% identity to SEQ ID NO: 53, 56, 58, 59, or 63 or an active fragment thereof; and
      (ii) said polypeptide has α-ketoisovalerate decarboxylase activity, a specificity ratio for α-ketoisovalerate to pyruvate greater than 1, and thiamine diphosphate cofactor activation constant ($K_c$) of about 20 μM or less; and
   b. contacting the recombinant host cell with a carbon substrate under conditions whereby isobutanol is produced.

9. The method of claim 8 wherein the recombinant host cell is *Saccharomyces cerevisiae*.

\* \* \* \* \*